United States Patent 7,745,391 (HUMAN THROMBOSPONDIN POLYPEPTIDE) - sequence listing, part 109

SEQ ID NO: 323284 - DNA, 6443 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcagtgttttgtgtgcctgctgtgtgtcagtcactgttagatgattcctctttaatgattggaattccgctactgaacttggatctcacctcaatagtagcaccttctttcactttgtggaattgtaggttcaagatagggcagcgtacgggagctttgggtttgccttctaagacatacaggcttcagttccaggtattcatgtgctagcttgaccctaggagaagctccagattctcatttgtgaaatgataacagtaatatctaccccttggggctactgcaaagacttgatacaagaacccagtaccctacctggcaattaataactgctcaataaaaatgtcttccttgtgtacttgtatttctcttcaactacacttgaggatccttgaggtcaggagctgtgtttcatttttcaccatatacccatcacctagtatgaattcacatataaagtagatgtggaacaaatgtttgttgaatagtgaatgaaggtgaatgaataagtgcataaagaaatggctccactcagagctaccccggtgatgaggataggggaatacttctattacattaaaggcaacagcagttagtaaaaaggtttttacagtgtttctgctgtttgaaagtgcaatataaattttttgctagcccatgatcaatcgacttctattgtttgatatacacttcagcatttaagttctgtcgaattgacatttgctacttataaacttagtccctaagtcttcttatgctgtgctatatatctaccattggcacttagtaaactatgccatcaaggccaacacagagcatcagggacttactgaaaggctgtaaaagtaccgtgtggaaaagaaatgccccttatggagaaaactgtaaatatcactgggaatccaatcaaattcatgttaactccatgaactgaagactcaaagtgccgcttttgtccttgactcattccctccttcctcttctgaccccctttcccctctcttcagcctgctaggatattgacagggattttagaggagtggaaggtctttatctctttgagatgagctgcaatatgattacaatcgattgagtgatttacagtatagagcacctttcattaccttctctgctttatagaagtataaatgacatactgtatgtgaatatatattattattattggatatttatgtaccacctttctcaaagaagctcagtgttctttttagactttaaataactagagagattctgcaaccttgtgcaaaatttaaattgaagagactggaacttggaaacttttcccataaataaaactatgctcttgtatgggtggtaggacacttggtgttcaggcagctctggggcagaggaaaaacggtacagggtaattgtattttatggctgggataataattctaagttttcataattagagacaacttctgcaggccagaatttgtattaactacttaaactagagcttccatgtgacaatagggaaaacaaaacttgtaattcactaaccagctttgaaattatgcaatatttgatgattgttttaattcagaagaatgtatgttattactgatgcctcacatagagggagatgttattaatatttttatttatgtcacactatttcagataagtataattttaaaaatcccataaagtgtgactacactgtatttctaatcttgaaagatattatttaattaaaatagatgcattatggttggaaatcaagaaaatctttatcttacatccctggttacattgtacctagaagtgaccctcaaatttttaattattcattttactgagtccctaaactataatatttataacatttaacatatggctaaataaatatgatgg

SEQ ID NO: 323285 - DNA, 418 bp, Homo sapiens
cggccgcccaggcgaggtgcggcctccgcacaggccggggggcgtaggcgcgcggggcccgccatggctgcgtcggagctctacacaaaggtaaggcaccccgcggccggcgtcgaggactggggctgtgcggccctcgccgccagctgtcaggctggggagggggcgggagcgccgggcccaggcgagccccaccagcgccatccccttcagcgcctcagaaccctcggccctaccagccggtcgcccgctgcggcaccttcctctttcgggcgagatggtgaaggcggcggaaggtggcccgcctcgggggtctcccaggcccctgccgcgctgctcgagctgggggcagagcgggcttcggagtggaaagggggcccatgtggatttagcagggcgggcgtgcctcccctcctgc

SEQ ID NO: 323286 - DNA, 714 bp, Homo sapiens
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323287 - DNA, 771 bp, Homo sapiens
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaagggggggttttgggggggggggggaaagggggtatgaaaaggggaatgggaatgggggttcgtggaccacattttttggtaccaagggggaaacttggggggccccataaagg

SEQ ID NO: 323288 - DNA, 674 bp, Homo sapiens
  misc_feature (26)..(26): n is a, c, g, or t
  misc_feature (594)..(594): n is a, c, g, or t
  misc_feature (613)..(613): n is a, c, g, or t
  misc_feature (619)..(619): n is a, c, g, or t
  misc_feature (622)..(622): n is a, c, g, or t
  misc_feature (626)..(626): n is a, c, g, or t
  misc_feature (631)..(631): n is a, c, g, or t
  misc_feature (636)..(637): n is a, c, g, or t
  misc_feature (639)..(639): n is a, c, g, or t
  misc_feature (642)..(642): n is a, c, g, or t
  misc_feature (654)..(655): n is a, c, g, or t
  misc_feature (661)..(661): n is a, c, g, or t
actatagctagtacgaggctggggtnaatcggccgactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaaaaanggggggggggcaaaaaatnccccgnggngggncccangtttnngngtnacccagtttttnnggtacnaaggggccccaat

SEQ ID NO: 323289 - DNA, 2221 bp, Homo sapiens
ggcacgaggcgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccaaaaaaaaaaaaaaaaaactcgagactagttctctctctcgaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaagaataaaatcaacaaactatctaacacatggtttggggctcgactggccctatcagaaattgtttcaatgacaacaatttcgtggtgagaggcagcacgtgggccacccctgagtggatcaactgcaccatggggccactaagaagcgagacaccacgaagagagaatactcggctacacaccaattgagtgtgggggagcgttcccccacgaaggaaaaaaatgcccggcgggagaaacagcaggggtgcttggccaaaagaagctgcaagagggggcagccagggagggccagaaagcgaggaccaacacaccaggggcgaggccaaggaaggactgcgaagagctaagatagacgccgga

SEQ ID NO: 323290 - DNA, 829 bp, Homo sapiens
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaaaaaagaaagacgagaacaaaaagaaaaaaaaaaaaaaaaattcttggggggggggcccggccccaattcccccttatagggagttgtttaaccccccctatttgcccgttgtttaaaaacgtgggaatgggaaaacccttggtttcccaaattaaatggcgttgaaaaaaa

SEQ ID NO: 323291 - DNA, 657 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaatcctgagctgacctgacctcattgccacctcttgcattgggatcctgagggctggcccctgctcactgatgggccctcccaggcccgt

SEQ ID NO: 323292 - DNA, 697 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaacacaacaagaaaagaaaagaaaaagaagaaaataagaaaaagaagaagcgagagcagagagaaggagaaaagaaaagagaagcaaaaaaaagacggggggcggggtaaaaaaagcggggggagaaac

SEQ ID NO: 323293 - DNA, 1013 bp, Homo sapiens
  misc_feature (1)..(1): n is a, c, g, or t
  misc_feature (999)..(999): n is a, c, g, or t
naaggattcaggctaggtacgaggctgggtggctgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaatcccgaaaaaattcccggaattttgggggcggggggaaagaggggggggtccccctttttcccggtaaaaaccttgtgtggggaaagggggggcccaaaaatatacacgggggggtggaaccctggcaagggggagaaataccgggaaacgtggttctaaatgggagcccaatttatgaaagggcagtctgatatggaaacgcctgtgggttctcaacatgtcccaacggttgggcacgcaaaatgccgctgggaaaggtggcccggaaaaaagggcttcaggggccaactttggcgacggcgaatgtggggaggcaaaaccacgcgcgacgaaggcgctttttaaagccacacacggttgggcgcgtaaaggcgacagcggtccacaggtgtagcacgaatcatgtgggggnaactgacaacgtag

SEQ ID NO: 323294 - DNA, 1946 bp, Homo sapiens
ggcacgaggcgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccaaaaaaaaaaaaaaaaaactcgagactagttctctctctcgaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323295 - DNA, 909 bp, Homo sapiens
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaacacaacaagaaaagaaaagaaaaagaagaaaataagaaaaagaagaagcgagagcagagagaaggagaaaagaaaagagaagcaaaaaaaagacggggggcggggtaaaaaaagcggggggagaaac

SEQ ID NO: 323296 - DNA, 1792 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggtaagaactgtctcaggtttggaaacatctcagtaaaagcagggtttgagcttcatgaaattctaagggcattttaaggagtttttacttgataccttgtagataatgggggtggaataagctttgatacttcctgtgcagtggagagtttagggtgtgagccttggaagctgagtctgttctgggtttggggcttcttcagttgtggtaccagggagcagatggcatcttgagggcctggcactcaatcatctgctatttgtggtttaataaagaactttgggctaggcatggtggctcgtgcctgtaatctcagcactttgggaggccaaggcaggcggattaccagcctgaacaacgtagagaaaccccatctctactaaaaatacaaaattagccgggcgtggtggcacatgcctgtaatcccagctactcgagaggctgaggcaggagaattgctcgaacccgagaggcggaggttgtggtgagctgagattgcgccattgcgctccagcctgggcaacaagagcaaaactccgtcttaaaaaaaaaaaaaaaaagaactctgaaggaacctttgttagatagtccttctctatgttagcattgcctttctagttgggcagctggggtgcataggcctggttctcagacaaggggatttgaagtttcagacgtgtcatattccaaaatgctgtgttaacaagtaaggcctcctatagatctacttcaagtttggccaggtttcctttaccaccttgtttttcagataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggtaattcagaggcagcaccttggtttggtggttgtgttaatcaaagcatatgtgtttggtgggtctctgctaaaaatgcccattttgttttttttctgtttctacatcaggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaaaaaagaaagacgagaacaaaaagaaaaaaaaaaaaaaaaattcttggggggggggcccggccccaattcccccttatagggagttgtttaaccccccctatttgcccgttgtttaaaaacgtgggaatgggaaaacccttggtttcccaaattaaatggcgttgaaaaaaa

SEQ ID NO: 323297 - DNA, 802 bp, Homo sapiens
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaaaaaagaaagacgagaacaaaaagaaaaaaaaaaaaaaaaattcttggggggggggcccggccccaattcccccttatagggagttgtttaaccccccctatttgcccgttgtttaaaaacgtgggaatgggaaaacccttggtttcccaaattaaatggcgttgaaaaaaa

SEQ ID NO: 323298 - DNA, 481 bp, Homo sapiens
tctggacacatttctccaactgctcgcatgctctctcactgttgttaggggatccgtgcagaaggccagctggcagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323299 - DNA, 488 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323300 - DNA, 1620 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggtaaggcaaggcgatccactcggccctcttctctgccctgaagcccaggacctagcccgccaaaacacgcacggggccctcttagcccccagtttaccctctagggtttgcatagtcgggagctctagttccctcgacctttccccagaattcgtccggtgactttggacagatagatgactagtttttctctgggcctcggcttctgcattctgtgaatgtagtgaaggtttgagagcgaaaatgttttgtggactaaagtcttgtaaaaatatgacctatgtttgcagtcagtcagatgttctgaagcccgcgtttcacagatttggggagcaaacagaccgccttgccccagctcaggttaggaatccctaccacatcttctatggaggttcggaagacctggccttgtgttccttttctttgaggaaggtgtgtgtctttggggacaatgaaagaatgtacgatgtgattctgtgatggaagagggagctctttcccagagaaagagtgctgctataattattgactgcttgctattccaagtgctttatatgcactaattaattttttttttttttttgagatggaatctcgctctgtcgcccaggctggagtgcagtggcgtggtctcggctcgctgcaacctccgcctcctgggttcaagcgattctcctgcctcagcctcccaggtagctgggactacaggtgtccgccaccacgcctggctaatttttgtgtttttagtagcgacgggggtttcactctgttggccaggctgatctcgaactcctgacctagtgatccgcccaccccggcctcccaaagtcctgggattacaggcgtgagccaccgcgcccggccctaattcatttcatctacacactattcctatgaagtaagtgttgggtactattagtgccatttttacagatgaggaaacaagcatagaggttaaatatcttttctaaggtcatgcagctaccaaattggtgcagccaggaattgcggccaagcagcgcggttctagaaccaggactcttatcaattttgcgacacagctactagttgtttctaatctcatttcctgtccgtctgttctctggtcacttgggggcagccattctgggctgtgggttcagaataattggagacttatttatcccttaatttttctagtcttattatttctaaaaagaaatagaacctgaggccgggcgcggtggctcacgcctgtaatcccaacactttgggaggacggccgaggcagacaggtagcatgagtccaggagttggaccagcctgggcaacgtggcgaaaccccgtctctacaaaaaatataaaaattagccgggcatggtggtgaacgcctgtggtctcaactgctcgggagtttgagcccaggaagtccaggctgcagtgagccgtgatcgtgtcctgcactccagccgaggcaacccgagtgagaccct

SEQ ID NO: 323301 - DNA, 1566 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggtaaggcaaggcgatccactcggccctcttctctgccctgaagcccaggacctagcccgccaaaacacgcacggggccctcttagcccccagtttaccctctagggtttgcatagtcgggagctctagttccctcgacctttccccagaattcgtccggtgactttggacagatagatgactagtttttctctgggcctcggcttctgcattctgtgaatgtagtgaaggtttgagagcgaaaatgttttgtggactaaagtcttgtaaaaatatgacctatgtttgcagtcagtcagatgttctgaagcccgcgtttcacagatttggggagcaaacagaccgccttgccccagctcaggttaggaatccctaccacatcttctatggaggttcggaagacctggccttgtgttccttttctttgaggaaggtgtgtgtctttggggacaatgaaagaatgtacgatgtgattctgtgatggaagagggagctctttcccagagaaagagtgctgctataattattgactgcttgctattccaagtgctttatatgcactaattaattttttttttttttttgagatggaatctcgctctgtcgcccaggctggagtgcagtggcgtggtctcggctcgctgcaacctccgcctcctgggttcaagcgattctcctgcctcagcctcccaggtagctgggactacaggtgtccgccaccacgcctggctaatttttgtgtttttagtagcgacgggggtttcactctgttggccaggctgatctcgaactcctgacctagtgatccgcccaccccggcctcccaaagtcctgggattacaggcgtgagccaccgcgcccggccctaattcatttcatctacacactattcctatgaagtaagtgttgggtactattagtgccatttttacagatgaggaaacaagcatagaggttaaatatcttttctaaggtcatgcagctaccaaattggtgcagccaggaattgcggccaagcagcgcggttctagaaccaggactcttatcaattttgcgacacagctactagttgtttctaatctcatttcctgtccgtctgttctctggtcacttgggggcagccattctgggctgtgggttcagaataattggagacttatttatcccttaatttttctagtcttattatttctactttgggaggacggccgaggcagacaggtagcatgagtccaggagttggaccagcctgggcaacgtggcgaaaccccgtctctacaaaaaatataaaaattagccgggcatggtggtgaacgcctgtggtctcaactgctcgggagtttgagcccaggaagtccaggctgcagtgagccgtgatcgtgtcctgcactccagccgaggcaacccgagtgagaccct

SEQ ID NO: 323302 - DNA, 691 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgcaaagaaggacttccattcattgttttggtgtatagcatagcctttttgagcctttcttcagcttcatgatgtgaccagaaccacgtgagcattccaagagcagacacaccccatttacagataagagaaccctccttgccttgtttacaaagctcttcagtatgctatatacacttggcttgacttttggccacaatagcaaac

SEQ ID NO: 323303 - DNA, 489 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323304 - DNA, 531 bp, Homo sapiens
tcatgagatagaagtttcaggaagttacttaaattaatgttgaattcttgtgacccatgtttcaaatttaatccaatggcaaaggtcatccctctctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323305 - DNA, 255 bp, Homo sapiens
tgattacctccttttctttcccccatctaggtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 323306 - DNA, 646 bp, Homo sapiens
  misc_feature (26)..(26): n is a, c, g, or t
actatagctagtacgaggctggggtnaatcggccgactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323307 - DNA, 1575 bp, Homo sapiens
taagaccctcatcaatagatggagacatacagaaatagtcaaaccacatctacaaaatgtcagtatcaggcggcggcttcgaagccaaagtgatgtttggatgtaaagtgaaatattagttggcggatgaagcagatagtgaggaaagttgagccaataatgacgtgaagtccgtggaagcctgtggctacaaaaaaatgttgagccgtagatgccgtcggaaatggtgaagggagactcgaagtactctgaggcttgtaggagggtaaaatagagacccagtaaaattgtaatgagcagtgcttgaattatttggtttcggttgttttctattagactatggtgagctcaggtgattgatactcctgatgcgagtaatacggatgtgtttaggagtgggacttctaggggatttagcggggtgatgcctgttgggggccagtgccctcctaattggggggtaggggctaggctggagtggtaaaaggctcagaaaaatcctgcgaagaaaaaaacttctgaggtaataaataggattatcccgtatcgaaggcctttttggacaggtggtgtgtggtggccttggtatgtgctttctcgtgttacatcgcgccatcattggtatatggttagtgtgttggttagtaggcctagtatgaggagcgttatggagtggaagtgaaatcacatggctaggccggaggtcattaggagggctgagagggcccctgttaggggtcatgggctgggttttactatatgataggcatgtgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaacacaacaagaaaagaaaagaaaaagaagaaaataagaaaaagaagaagcgagagcagagagaaggagaaaagaaaagagaagcaaaaaaaagacggggggcggggtaaaaaaagcggggggagaaac

SEQ ID NO: 323308 - DNA, 777 bp, Homo sapiens
  misc_feature (7)..(7): n is a, c, g, or t
  misc_feature (31)..(31): n is a, c, g, or t
  misc_feature (76)..(76): n is a, c, g, or t
  misc_feature (104)..(104): n is a, c, g, or t
  misc_feature (183)..(183): n is a, c, g, or t
gatcganagatatgaagtttcctgcacttgnatgtgtcggcggctgttggcacagggccagcgctcaccgcccagncaggcgctcagcagcaagagcagggccncgaggctcctcatggctatgggctcctctgccttggtatatcccacaggctcggtctagcaacagaagggccacgcctnccctgcaacagggcagctcgtgccgaattcggcacgagctgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggatggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323309 - DNA, 1258 bp, Homo sapiens
  misc_feature (1244)..(1244): n is a, c, g, or t
gggcagatgaaggtatcacggagatactggataccctcattggtaaggtacccacgtagaaatgtctccaggcaaaactgttcccttcacgtagcctcgggacttgagagacttgcatggccttcatagacatgaaggttgggcacattcttgtctgccagctccgggtgcttaggcatgtggacatccttcttggccaccatgactccctccttaaaaaggagttcataaatggcaatccggttcttcttaggcatcaacatctctgcggctgcaggtgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaatcccgaaaaaattcccggaattttgggggcggggggaaagaggggggggtccccctttttcccggtaaaaaccttgtgtggggaaagggggggcccaaaaatatacacgggggggtggaaccctggcaagggggagaaataccgggaaacgtggttctaaatgggagcccaatttatgaaagggcagtctgatatggaaacgcctgtgggttctcaacatgtcccaacggttgggcacgcaaaatgccgctgggaaaggtggcccggaaaaaagggcttcaggggccaactttggcgacggcgaatgtggggaggcaaaaccacgcgcgacgaaggcgctttttaaagccacacacggttgggcgcgtaaaggcgacagcggtccacaggtgtagcacgaatcatgtgggggnaactgacaacgtag

SEQ ID NO: 323310 - DNA, 800 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaggaaacaaagaatgccgaaaagaatgaaaacagacaaaaaatgtatgtgcttgaaaagtaaaatacttacaatagtaacttaactatttcactcttcaggggggggcacgaaaccaattcgcccatactggaataatatgtcacctccacaatgtttttattttcaaatatttttaatgggaaacactttagggtgtccaaactgtatttttcgtaacaaacccccgttattacaaag

SEQ ID NO: 323311 - DNA, 642 bp, Homo sapiens
  misc_feature (1)..(1): n is a, c, g, or t
naaggattcaggctaggtacgaggctgggtggctgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323312 - DNA, 1085 bp, Homo sapiens
  misc_feature (1071)..(1071): n is a, c, g, or t
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaatcccgaaaaaattcccggaattttgggggcggggggaaagaggggggggtccccctttttcccggtaaaaaccttgtgtggggaaagggggggcccaaaaatatacacgggggggtggaaccctggcaagggggagaaataccgggaaacgtggttctaaatgggagcccaatttatgaaagggcagtctgatatggaaacgcctgtgggttctcaacatgtcccaacggttgggcacgcaaaatgccgctgggaaaggtggcccggaaaaaagggcttcaggggccaactttggcgacggcgaatgtggggaggcaaaaccacgcgcgacgaaggcgctttttaaagccacacacggttgggcgcgtaaaggcgacagcggtccacaggtgtagcacgaatcatgtgggggnaactgacaacgtag

SEQ ID NO: 323313 - DNA, 742 bp, Homo sapiens
  misc_feature (662)..(662): n is a, c, g, or t
  misc_feature (681)..(681): n is a, c, g, or t
  misc_feature (687)..(687): n is a, c, g, or t
  misc_feature (690)..(690): n is a, c, g, or t
  misc_feature (694)..(694): n is a, c, g, or t
  misc_feature (699)..(699): n is a, c, g, or t
  misc_feature (704)..(705): n is a, c, g, or t
  misc_feature (707)..(707): n is a, c, g, or t
  misc_feature (710)..(710): n is a, c, g, or t
  misc_feature (722)..(723): n is a, c, g, or t
  misc_feature (729)..(729): n is a, c, g, or t
caatctgagcatgtgttcgcgaccacgatgagtgtgccgcacttccggccagatcgccggatttccgctgagtgacccttacaagtccttcttgatcctgaactgtgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaacaaaaaaaaaaaaaaaaaaaaaanggggggggggcaaaaaatnccccgnggngggncccangtttnngngtnacccagtttttnnggtacnaaggggccccaat

SEQ ID NO: 323314 - DNA, 650 bp, Homo sapiens
  misc_feature (6)..(6): n is a, c, g, or t
gcggcnctactactactaaattcgcggccgcgtcgacgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaacaacaacaagacagaacgacacgaaaaaggagcacaaacagacgcaaagacaacaacaagaagacacaacacaacaaaagggc

SEQ ID NO: 323315 - DNA, 1109 bp, Homo sapiens
ctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaattgtttccttcaaatggggtctgccaattcacaaccagatgacccattttaccctattcactgcagactgaatccagattctacacatacttatccccaccaagaccctcactctgtctccattggcctacttgttcatctttcactcattcgacaaatctttctgaggtaagagcgaggtgggacaaaaaaaaaaaagcataccaatgaaccagacacggtcttattaaagataatataggttta

SEQ ID NO: 323316 - DNA, 444 bp, Homo sapiens
tactactactactaaattcgcggccgctcgatatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaa

SEQ ID NO: 323317 - DNA, 585 bp, Homo sapiens
cctttagtaaagagactacccaaggatgatcttccagaaggggaatgattctaaaaggattatctggaattggaaaactagttagcccataaatgatcaccataagtaaatttaaaccgttgtttgtataaaaccattataatgaagtgtttataagaaattgtgcacccatgtgaaacttaatgtgctgaattccgcacctcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatgtgtgctgaagggatcctctagactcacctacgctc

SEQ ID NO: 323318 - DNA, 348 bp, Homo sapiens
tactactactactaaattcgcggccgctcgaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcatgtcgacgcggccgcgaatttagtag

SEQ ID NO: 323319 - DNA, 795 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactaaaactgcgctgagagccattcacataatctctgagaaacgacttccttacttgtgcgcagcgtgagccggtacatctgggcttgcaggttcggctccaagcgcagcaggcatccaatctgggtggttttcgtgtggatgattccagctcccacgaaattcgcaggattaggatcaacttcttcaagaagtgcagaaccaaatcctatgatcttggctttggtgacttctgtgtccattgggtgctttgctttgaagatgttctgcacttcctgttgctcaactgcttcgcaacgttgaaagaaatcctgagaagccatttctgtcggctggaagaatttgttgagagtgatgggcagctgcacagacacgttctggaaggtgcccccatacctgaactgaatgttgaggactgcgccgcctgaagtcgacaccctctatgtgcca

SEQ ID NO: 323320 - DNA, 537 bp, Homo sapiens
attcaacattgctagttagttggcatgccagatttctcctagtgtgtttaattttgagagagaaactccaacaaatgcattttatcactagtggtcagggagatttaaagaataaattggcttttgaaaatcaaagaccaaaatactgttatctgatgtgaataatgtcaaagaactctctcacaggcagtcacaagtctcgggtattgcaagggaacatgaaactggttaatggaatcctcaccaggtgttctgctttagttatgatggttgttactgatctgttttacatttcaaaggaaaaccatggtctagtaagaaaatacccttttcatttcaggcgttttgaagagaatggagtggctcttggaactgatgggttatattagaaatgttgcttaccagtcaacatccattcactatacttttctaactgagttgtcctacatgcaagtacatgtttttaatgttgtctgtcttctgtgctgttcctgtaagtttgctattaaaatacattaaactataaaaaaaaaaaaa

SEQ ID NO: 323321 - DNA, 382 bp, Homo sapiens
ataaaccgctgaaacttgttcactgaaacattttaacttgcattaatgctttacgtctccgcatttatattaaatcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattttttgtacccagtccagagatccccggctttcttttgtacgattaaactgccgccctggaggctcttttaccttaatgccccgggcctcctctcttccaggaaa

SEQ ID NO: 323322 - DNA, 549 bp, Homo sapiens
  misc_feature (37)..(38): n is a, c, g, or t
gactccagaggatccccaagcttttaccgcattctcnnatcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaa

SEQ ID NO: 323323 - DNA, 1336 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaaaaaaaagggaaaaacaaacacaaaacaaaaaaaaaccttgtgcggcacggccggccccgaaagaacttttaaaaaccccgtggggggccgagccccataaaatacactggccaacggttcccaaaaaccgggcaaaaaaagcgcgggttcttccccaaaaaacgcgcgggggaacccgagctgggcgaaaaccggaaggaccaggagcaaagaggtcacacggggcccaggacctaaagccagcgagagggaaacaaacaaaaacaacgaaacaaga

SEQ ID NO: 323324 - DNA, 1276 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaaccgcaaaaaaaaacaaaataaatgaataacaacaacacaaagacaaaaaacaatgtcatcagaacataaccacgatataataacgataagtggatgatagaaagacggagggagcgtgatcgcaccgtgtcgatgtccgccttcagctggtcgactcgcttctctgtggcggtctgacgccctttgtctatcctggtactgcggccggatgattggg

SEQ ID NO: 323325 - DNA, 1207 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaataattatttatcattataatttattatattcatttatacttttatttatatcatttttccttatttttatttataatatttacttttggtgtggctctttactcaattctatttttggattgttttttactttaattggcctttattt

SEQ ID NO: 323326 - DNA, 1048 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttccgcaatgtcggggatccttagaatcgacacgcatc

SEQ ID NO: 323327 - DNA, 898 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatg

SEQ ID NO: 323328 - DNA, 940 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatgaaaaaaatttgggaggattaaaaccttcaggggggggcccga

SEQ ID NO: 323329 - DNA, 871 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaataaaaaaaaaaagtcgacgcggcgcgcaat

SEQ ID NO: 323330 - DNA, 829 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcatatgcagtaatgttcaggacagtcagcgtcactatatatatatacttattctgacacagcatgattaacacgatctta

SEQ ID NO: 323331 - DNA, 1059 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaa

SEQ ID NO: 323332 - DNA, 315 bp, Homo sapiens
cggtaccccctagttttagaagtttcaatagcagggtatggatgaggagctggaaagagatgagaaggtatttctgcttggagaagaagttgcccagtatgatggggcatacaaggttagtcgagggctgtggaagaaatatgggtttcaataggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaa

SEQ ID NO: 323333 - DNA, 1155 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaacttaatatcatcccctataactactttcattttctaacaattatccctaaagtacaataaacttctccacgaaactaaatgctaactctgcccccc

SEQ ID NO: 323334 - DNA, 1086 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaaaaaaaaggcggccgctcgcgatctagaactagt

SEQ ID NO: 323335 - DNA, 1015 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcacgattgtcaccggggatccactagagtcggccgcaggaaggagttcaaa

SEQ ID NO: 323336 - DNA, 933 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatgtgtgctgaagggatcctctagactcacctacgctc

SEQ ID NO: 323337 - DNA, 886 bp, Homo sapiens
  misc_feature (1)..(2): n is a, c, g, or t
  misc_feature (5)..(5): n is a, c, g, or t
nnatnggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaattcaataagaaatttacttgttttaaaaaaatccaaatgctggtc

SEQ ID NO: 323338 - DNA, 3133 bp, Homo sapiens
ccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323339 - DNA, 758 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggtcctgtccgtcagtcctcagaaccccagatcactcattctttgcccttggccctgccaaggggcttatccccggctgcgtgtcccctctgactctagtctctgtgtccagtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagccaaccaggcgtgagtcagtcctgcctggctccttgctctccgcggggtccgcttccctgggtcagcctcacgccctgcatgggcagggcccaggaaatgcttgttgactaaaaaaatgccagtgccagcaggccagggggaagcactggctttgggcccacaccctgccccagagagcgccctacgaactcctgctgctccctgcactgctggatctgagggaagtggcctcacaggatgccttgggaagactggggctttgagaaacc

SEQ ID NO: 323340 - DNA, 446 bp, Homo sapiens
ggtcttcctcctgcctccagattccagctcaggggttgccaggtccctttgcgggtcttcctgaacttgcttctcttgcagctttagagactgggcaaggaagggagagtggatttccatctcctaactcttttctaggattcccgcctctgccaactctgctctctctgcacccctaggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcactccagcctgggcgacagcgagactcggtctcaaaaaaaaataaataaataaaataaataaat

SEQ ID NO: 323341 - DNA, 3459 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323342 - DNA, 3055 bp, Homo sapiens
gcggcactcaagccgaaaggccaccgacactcgcctgcggggatcagggcgggatgacctgggtaccgcggtcacgccaaggccgaggccctcacccttcccctctttgggaaagggcagacaagttccgggttcccttctaggtccgggcgagggggagagcgccccacagacgacaggcgcctcctgcctctctccttcaataaacagtccacagtgtcccggctgggctcgccgtggcctccgccttcccggcggacacacctgtttacccttcaccgccggacggccaggaggcgccacgacgaccccagccccgcccaggcttctccgggatggaccggcctcccggggcacagatgaggaccctgaccccggaggggccagacactcgctccagggcccctggcctgaccctcttcccctcgccccttcaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323343 - DNA, 2560 bp, Homo sapiens
ccggccagcgggcgggctccccagccaggccgctgcacctgtcaggtgagggggaggagaggtttggctgccagattcaactggaaaggaaccagtcccagtccagccgcaacctgggagtgggaagctggaggcagcccagacctcctggagccctgcagtcctggggcagagacagaatcaggacacagctcgagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323344 - DNA, 3529 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaaaaaaaaaaaaacaaaccggggacacaaagcgggcgcgaaaacgaggtagaagggcaaggctaggtccga

SEQ ID NO: 323345 - DNA, 3302 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgcccatcatcctgcttggagcaagtaggcaggagctcaataaatgtttgttgcatgaa

SEQ ID NO: 323346 - DNA, 856 bp, Homo sapiens
accgatgtgcataagatgtctggtgctgccactgatacccgtgtacgctgtgtacacatctggatgtggcatactcaagagtcgactcatgtctctttgctcccttgggatcatggcacgcggaaactagagaacgctctgggcctggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323347 - DNA, 1669 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcactccagcctgggcgacagcgagactcggtctcaaaaaaaaataaataaataaaataaataaat

SEQ ID NO: 323348 - DNA, 862 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtcggttagtccctctgcccc

SEQ ID NO: 323349 - DNA, 319 bp, Homo sapiens
ccggccagcgggcgggctccccagccaggccgctgcacctgtcaggtgagggggaggagaggtttggctgccagattcaactggaaaggaaccagtcccagtccagccgcaacctgggagtgggaagctggaggcagcccagacctcctggagccctgcagtcctggggcagagacagaatcaggacacagctcgaggtcagggccagaggctggagctgagggcctagagtgagagggggcaaggcaagggggggagaggaagagaggcaggattagagagaggaggcaggccagaaagaggagagcaggagagaccc

SEQ ID NO: 323350 - DNA, 431 bp, Homo sapiens
caccactggtcacactttctcctttaaccctgctcccctcctccccttcattcattcattcattcattcattcattcattcctcactcaacaactatttattaatcatctcctctatctcctagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggtgagaggagcctggactagaaggtagatgtgtgaccttgggccagctgtttgagctctctgagccttagcttcctcctctgtgatatgaggatgagactctcac

SEQ ID NO: 323351 - DNA, 337 bp, Homo sapiens
ccagggggctgctgagaggctgagaggactcgggggtcttcagggatgaagggagacagcttggtgaggagggaagggggctcctctgccagagtccatccagaaccctctgtcccatcgtcaatgtacctctcctctcacagatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccac

SEQ ID NO: 323352 - DNA, 802 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctttgatccgagtttccaagcggttccttaccgaagaaggctctttagaaggttcctttcttgggaagaaagaaccagcaattccaacgggcggcccattcccgcccttgggtgttggtcccccagggacagaaaccggcacttgactgaccggggcctttccttggggcaagttggcttggtggggttcttggccaccttttttggggccttgcaattgttacctgagtcttccg

SEQ ID NO: 323353 - DNA, 2826 bp, Homo sapiens
tcaacgctttatacttctactactttttcactcccatctgcatagtctgtgtctggctcccgtcgctagctccaagatggcagggtagcagaacacagatcctctctgtgccgtgtggcacatgtgctgtgctacaacccacacagcctccctgttctggaacctgtgatttgctgtgaaattgcagtcctactgcagctgtgttgcctctgtgattgctttctctctgtccccacacctgtcacagatgagttttggacctaccattctgagacatactgatgcaagaggctcccaggaaacacttggtactgatcttcctcccctcagctccgtgctcaccactggtcacactttctcctttaaccctgctcccctcctccccttcattcattcattcattcattcattcattcattcctcactcaacaactatttattaatcatctcctctatctcctagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323354 - DNA, 2089 bp, Homo sapiens
tatctatactgacctatctatactacctatctatactacctatctatactgacctatctatactaccttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323355 - DNA, 1646 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaa

SEQ ID NO: 323356 - DNA, 1816 bp, Homo sapiens
gagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctcaaccagcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggtgagactccagggagcccccaccctgccccac

SEQ ID NO: 323357 - DNA, 715 bp, Homo sapiens
ccggccagcgggcgggctccccagccaggccgctgcacctgtcaggtgagggggaggagaggtttggctgccagattcaactggaaaggaaccagtcccagtccagccgcaacctgggagtgggaagctggaggcagcccagacctcctggagccctgcagtcctggggcagagacagaatcaggacacagctcgaggaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggtgagactccagggagcccccaccctgccccac

SEQ ID NO: 323358 - DNA, 639 bp, Homo sapiens
ccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaggaatgtctggagagctggatggggcatcatgaagagggtagggggtggatacaagtcatcacccaagcttctgggaggtcctggggctgggagagggtacag

SEQ ID NO: 323359 - DNA, 2449 bp, Homo sapiens
ctgaactgcaattcctgttttgtctggacaccatgtacaactaaaaatgacaagttgaagtttctacttgaacttgttaaagtcacatatgaaagcagatagactattactgtggaagaacaattctaagtaatttcagtctgtaagaattgttctatgtcctgttataagacattattccatcaaagtctctatgtgacagactgcaatatattggaatacatttaatcatgttttacttttctattttcggttattttgctttgtatgctgtttctgtaaaaatttcccccatattaagtcctataaattaatcagaattaaatcctgtcttaactttcatataaggatatttggcttctgagttggtgataaacaaggttttgacttctgcatgatactgaagagtactttaagccaagaaagttctaattcaagtcagtactcatatccaggacaatcagatcgatatattttttttaatttttaaaattaaagttagactaaactaacttaaacttagactgaaataaagaaatctcatataaggccaggtgcgatggctcacacctgtaatcccagtactttgggaagccaaggtgggcagatcacatgaggacaggagttccagaacagcctcgccaacatggcaaaaccctgtctctactaaaaatacaaaaattagccaggtgtggtggtacacatctgtcatctcagcttcttgggaggccgaggcatgagaatcacttgaaccccggaggcggaaattgcaatgagccgagatttgtgccaccacactctaacctgggagacagaaaagaaaagaaaagaaatctcatgtatgagaagcttagatcataacattaaatgcttaaggtattttgaagttaactatttacttgaacacttaaatatgtaacattttacatataatgctgctgttatagtatatgacaaagcaaaggtatgatttttttcataatccccaaatcttgtactgttcttttattggcttttattagctaaaaatgaatgccaataacagacgtagtatttaatttagttcttttaaacaccacagaaatgatgcgcattcctagtcatagattagtgataagatagagataaagggaagaaaagtttatatgtatatatgaaagacatttaagattctaccttttggtagaatgaaaatgggagaacacaagctctcttgttggcctcattgtattattaatgagccttgactttttcaacaaatgttgtggagtctaaacaagcagtcggtattgaatactaatatctgagaagacctaggttttcatcaccctgaaaattttggatgatagcaaactttgaatttttatatctaaaaatatacaatattatcagtttggtacactgttgaatatttgaagcaagatttcagattttagtttaggtgtaatagaattatccattctgaagtttaatttgctttacttttagctggcatgaaacacaaaacacttgatgaaaaaatttgattatctgggcaggtgcagtggctcatacctgtaattgcaatactttaggagaccaaggcaggaggattgcgttagcccaagaatttgagaccagcctgggcaatatagcaataccttgtctctaccatgtttaaaaaaaaaaatcagtttagtgtgtgtgaatgtaggtatcagttgtttaggacttaaaggcgataatatgactgtggtgccattttaatccttgttttaactttttttggatttttttagatgactctagtgtagcataaaattaaacttttgcgccaggtgtgtggtggctcacgcctgtaatcccagcactttgggaggttgaggtgggtggatcatttgacgtcaggaatttgagaccagcctggccaacatggtgataccccatctctacaaaaaatgtaaaaattagctgggtgtggtggtgtgcacctgtaatcccagctactcgggaagctgaggcacgagagtcgcttgaacctgagaagcagaggttgcagtgagccaagatcatgcccctgcattctagcctgggcgacagagcgaacctctgtctcaaaaaaatgaaaaaattaaacttgaatgaataatgaaaaaaaaagggacaaaactatatttaaaaattttagactgggtgcagtggctcacacttgtaatcccagcagtttgggagctgagacaggcagattatttgagcccaggagttcgagaccagcctggacaacatggcaagaccttgcctctacaaaaaaatcggaaaatagccaggcatggtgccatacacctgtggtcccagctactcagaaggctaaagtggggggattgcttgagcacagaaaggtcgaggctgcagtaagctatgattatgccatggcattccaacctaggcaacagagcaagactcttattta

SEQ ID NO: 323360 - DNA, 1410 bp, Homo sapiens
  misc_feature (1407)..(1408): n is a, c, g, or t
cggaattagggagatagttggtattaggattaggattgttgtgaagtatagtacggatgctacttgtgcaatgatggtaaaagggtagcttactggttgtcctccgattcaggttagaatgaggaggtctgcggcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacgcaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatcaaaaaannaa

SEQ ID NO: 323361 - DNA, 400 bp, Homo sapiens
atgcggtgcctgtttgggaggtctgaaaggctcaggttggagcacagaggtctcacagcccctgagctttggccaggtgatgccacaaccccaacctgactttcttcttctcctagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgat

SEQ ID NO: 323362 - DNA, 3126 bp, Homo sapiens
aactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaagagcttcagccggagctcatttcttattgaacatcagagaatccacactggagagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagatgatccatgcagaggtgaaaacccaagaaacccatgaatgtgatgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatggatcagatttagtgataaagcaaattctccttgggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttaagctttg

SEQ ID NO: 323363 - DNA, 3168 bp, Homo sapiens
aactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggggttgctgacatttgaggatgtggctgtgttttttacccaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaagagcttcagccggagctcatttcttattgaacatcagagaatccacactggagagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagatgatccatgcagaggtgaaaacccaagaaacccatgaatgtgatgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatggatcagatttagtgataaagcaaattctccttgggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttaagctttg

SEQ ID NO: 323364 - DNA, 4450 bp, Homo sapiens
  misc_feature (829)..(829): n is a, c, g, or t
tgctggaaacagaaaccagatttcgccacaggttgcagaatagattgaataggaagaggttgggcttggaaaacataagaaatagaaaacctcggtgttaagattttttttcaatgcttggctttcataaagagaaggatttcaggttcaagataaaattggacatatttatgtaatggtaggaaagtgtcaatagagagtgtgtattgaagaaagaggaaagacgggataattaagcaaatgcccagaggtgagtaggatcggtaagtgatggatggattagccttgcataagaatcagatatatctttatgtaccattggcagataattttataggtagaggacagaaagttgagggagttctttcatgttttttcattatgtgaaagaaaatacagcccactgaaaaatttgagaggggacactaaaaagccttagaagaaataaaatttctagtagtttcttaggggaataggaaaaggttattttagaataaaataatgaagtaagcaaatagaaaattcaaagatgactccacaaaaaattgagagaaaagaggatgtatgaaaaaggagcttgtttagggccaaatataaatgtggtcattattgaatcttctagcggaattatctaatatctattccagcaagagatggaaaatcaggaagatgtccgaagcgggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagngtttagaatcacatgtacttgaggtatgatttgtggtaggtaaagtcataagctaccacagactgccctttttggttgttgctcccatgaactctgaccatgtttcttaatacttattttattctgcatctcgatatcatagactctctgtcacctaacccttattattgtttttaaaagccattttgtctctttatacaggagctgctttttacttaatattttctttatcatattattttctttccccattttttacttaacatccattccatttggcaggggggcttcatgtcttatctctgaatcctggctgattacaatgtttctggagtgcttttgatgggcagtgagtaaatgcttgttaatgaatgaattattgtttcccctggatctttgtcttttatccttcttagcatctttttttatttttatttttatttttttgagattaggtctcactctattgcctaggctggtgtgcagcgacgcaaacacagcttgctgcagcctcaacctgttgggcttaagtgatcaatcctcccacctcagctacctgagtagctgggactacaggtgtgtaccaccatgtctggctaattaaaaaaaaattttttttttgtagagatgaagtctcactgttgcccaggctggtctcaaactcctgagctcaagtgatcctcccacctcactctcccaaaatgctgggattacaggcatgagccactatgcctggccattagcatctggtcccttctgttaattatttggtctgatcatattccaataatgctttctcatccttaattttcttgaacttagtggagttttttttcatcctaccctgttttccttgatagactgattaatcccaccttgactttatttgtttctttgtttgcccatcttactttgtttctccttgcttcaaagaccttggttgatctttgtatttcctttttattattccagatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaatttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaagagcttcagccggagctcatttcttattgaacatcagagaatccacactggagagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagatgatccatgcagaggtgaaaacccaagaaacccatgaatgtgatgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatggatcagatttagtgataaagcaaattctccttgggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttaagctttg

SEQ ID NO: 323365 - DNA, 4644 bp, Homo sapiens
  misc_feature (829)..(829): n is a, c, g, or t
tgctggaaacagaaaccagatttcgccacaggttgcagaatagattgaataggaagaggttgggcttggaaaacataagaaatagaaaacctcggtgttaagattttttttcaatgcttggctttcataaagagaaggatttcaggttcaagataaaattggacatatttatgtaatggtaggaaagtgtcaatagagagtgtgtattgaagaaagaggaaagacgggataattaagcaaatgcccagaggtgagtaggatcggtaagtgatggatggattagccttgcataagaatcagatatatctttatgtaccattggcagataattttataggtagaggacagaaagttgagggagttctttcatgttttttcattatgtgaaagaaaatacagcccactgaaaaatttgagaggggacactaaaaagccttagaagaaataaaatttctagtagtttcttaggggaataggaaaaggttattttagaataaaataatgaagtaagcaaatagaaaattcaaagatgactccacaaaaaattgagagaaaagaggatgtatgaaaaaggagcttgtttagggccaaatataaatgtggtcattattgaatcttctagcggaattatctaatatctattccagcaagagatggaaaatcaggaagatgtccgaagcgggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagngtttagaatcacatgtacttgaggtatgatttgtggtaggtaaagtcataagctaccacagactgccctttttggttgttgctcccatgaactctgaccatgtttcttaatacttattttattctgcatctcgatatcatagactctctgtcacctaacccttattattgtttttaaaagccattttgtctctttatacaggagctgctttttacttaatattttctttatcatattattttctttccccattttttacttaacatccattccatttggcaggggggcttcatgtcttatctctgaatcctggctgattacaatgtttctggagtgcttttgatgggcagtgagtaaatgcttgttaatgaatgaattattgtttcccctggatctttgtcttttatccttcttagcatctttttttatttttatttttatttttttgagattaggtctcactctattgcctaggctggtgtgcagcgacgcaaacacagcttgctgcagcctcaacctgttgggcttaagtgatcaatcctcccacctcagctacctgagtagctgggactacaggtgtgtaccaccatgtctggctaattaaaaaaaaattttttttttgtagagatgaagtctcactgttgcccaggctggtctcaaactcctgagctcaagtgatcctcccacctcactctcccaaaatgctgggattacaggcatgagccactatgcctggccattagcatctggtcccttctgttaattatttggtctgatcatattccaataatgctttctcatccttaattttcttgaacttagtggagttttttttcatcctaccctgttttccttgatagactgattaatcccaccttgactttatttgtttctttgtttgcccatcttactttgtttctccttgcttcaaagaccttggttgatctttgtatttcctttttattattccagatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaagagcttcagccggagctcatttcttattgaacatcagagaatccacactggagagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagatgatccatgcagaggtgaaaacccaagaaacccatgaatgtgatgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatggatcagatttagtgataaagcaaattctccttgggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttaagctttgtgtaagagttgttactttaagtgtaaaaccaattctgtcaaacgcattactgtgtttttaaaattagaatcaaaaataggaaggaaatagctgtcatttgttctgtgtg

SEQ ID NO: 323366 - DNA, 3262 bp, Homo sapiens
aactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaagagagacttgataaatcggcctgagaaaataagtaatgctccagactagctctctcatttgtgagttctccaggtgaagcaccatttttgaccttcccttgtgtcttctgttcctggcacagtgcctggaccccaaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaagagcttcagccggagctcatttcttattgaacatcagagaatccacactggagagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagatgatccatgcagaggtgaaaacccaagaaacccatgaatgtgatgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatggatcagatttagtgataaagcaaattctccttgggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttaagctttg

SEQ ID NO: 323367 - DNA, 4535 bp, Homo sapiens
  misc_feature (829)..(829): n is a, c, g, or t
tgctggaaacagaaaccagatttcgccacaggttgcagaatagattgaataggaagaggttgggcttggaaaacataagaaatagaaaacctcggtgttaagattttttttcaatgcttggctttcataaagagaaggatttcaggttcaagataaaattggacatatttatgtaatggtaggaaagtgtcaatagagagtgtgtattgaagaaagaggaaagacgggataattaagcaaatgcccagaggtgagtaggatcggtaagtgatggatggattagccttgcataagaatcagatatatctttatgtaccattggcagataattttataggtagaggacagaaagttgagggagttctttcatgttttttcattatgtgaaagaaaatacagcccactgaaaaatttgagaggggacactaaaaagccttagaagaaataaaatttctagtagtttcttaggggaataggaaaaggttattttagaataaaataatgaagtaagcaaatagaaaattcaaagatgactccacaaaaaattgagagaaaagaggatgtatgaaaaaggagcttgtttagggccaaatataaatgtggtcattattgaatcttctagcggaattatctaatatctattccagcaagagatggaaaatcaggaagatgtccgaagcgggcctagatgtactatatgacactctgttatatcatagaccactgtgctgtcttttcttcaacacatgcaagattttcatttctcagatgtcatgcagcctctcagttggaacaagatggtgaaccttgggtcttatattgttagagngtttagaatcacatgtacttgaggtatgatttgtggtaggtaaagtcataagctaccacagactgccctttttggttgttgctcccatgaactctgaccatgtttcttaatacttattttattctgcatctcgatatcatagactctctgtcacctaacccttattattgtttttaaaagccattttgtctctttatacaggagctgctttttacttaatattttctttatcatattattttctttccccattttttacttaacatccattccatttggcaggggggcttcatgtcttatctctgaatcctggctgattacaatgtttctggagtgcttttgatgggcagtgagtaaatgcttgttaatgaatgaattattgtttcccctggatctttgtcttttatccttcttagcatctttttttatttttatttttatttttttgagattaggtctcactctattgcctaggctggtgtgcagcgacgcaaacacagcttgctgcagcctcaacctgttgggcttaagtgatcaatcctcccacctcagctacctgagtagctgggactacaggtgtgtaccaccatgtctggctaattaaaaaaaaattttttttttgtagagatgaagtctcactgttgcccaggctggtctcaaactcctgagctcaagtgatcctcccacctcactctcccaaaatgctgggattacaggcatgagccactatgcctggccattagcatctggtcccttctgttaattatttggtctgatcatattccaataatgctttctcatccttaattttcttgaacttagtggagttttttttcatcctaccctgttttccttgatagactgattaatcccaccttgactttatttgtttctttgtttgcccatcttactttgtttctccttgcttcaaagaccttggttgatctttgtatttcctttttattattccagatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaagagcttcagccggagctcatttcttattgaacatcagagaatccacactggagagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagatgatccatgcagaggtgaaaacccaagaaacccatgaatgtgatgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatggatcagatttagtgataaagcaaattctccttgggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttaagctttg

SEQ ID NO: 323368 - DNA, 669 bp, Homo sapiens
  misc_feature (354)..(354): n is a, c, g, or t
tcttacgtggactcagagggctccccagtgggtgtggtccagctcaccttcctgcggctgctcagcgtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcggnaggagatcgagcagatgaggcggccaacagggacccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcaaaagtgtctg

SEQ ID NO: 323369 - DNA, 5847 bp, Homo sapiens
  misc_feature (79)..(79): n is a, c, g, or t
  misc_feature (869)..(869): n is a, c, g, or t
  misc_feature (1242)..(1242): n is a, c, g, or t
  misc_feature (1277)..(1277): n is a, c, g, or t
  misc_feature (1296)..(1296): n is a, c, g, or t
  misc_feature (1643)..(1643): n is a, c, g, or t
  misc_feature (1809)..(1809): n is a, c, g, or t
  misc_feature (1826)..(1826): n is a, c, g, or t
  misc_feature (2262)..(2262): n is a, c, g, or t
  misc_feature (2297)..(2297): n is a, c, g, or t
  misc_feature (2333)..(2333): n is a, c, g, or t
  misc_feature (2348)..(2348): n is a, c, g, or t
  misc_feature (2919)..(2920): n is a, c, g, or t
  misc_feature (2989)..(2989): n is a, c, g, or t
  misc_feature (3017)..(3018): n is a, c, g, or t
  misc_feature (4298)..(4298): n is a, c, g, or t
cccctgtggatgtgctccgggccctgaggttcccctccctccctgatggtgtccggagagcgaaaggcatctgtccagntgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggaccccaccccaggtgaagaggaagaaatcctggagtcgagcctcttgccaccccttgaggaggctgcccatggaccccgagggctgaagggagagaaaggagagcctgcagtgttggaacctggtatgctcgtggaggggccccctggcccagaaggncctgcgggattgattggtccccctggcatccaggggaacccaggcccagttggagaccctggagagaggggcccccctggccgagcagggctccctggatcagatggggctcctggtcctcctggcacatctctcatgctcccattccggtttggcagtggtgggggtgacaagggccctgtggtggcggcccaggaggctcaggcccaggcgatcctgcagcaggcgaggctggcgctccgtggaccccctggccccatgggatacacagggcgccctggacccttgggccaacctgggagccctggcctgaaaggagagtctggagacttaggacctcagggccccagaggacctcagggcctcacaggcnccctggcaaggctgggcgaaggggccgggcaggtnctgatggagcccgagggancctggagatcctggagtgaagggtgaccgaggttttgatggactcccagggctccctggagagaagggccataggggtgatactggtcccagggccttcctggtccccctggtgaggatggagagaggggagatgacggggagattgggcctcgagggctgcctggagagtcgggacctcgaggtctccttggccccaaaggcccacctggtattcctggaccccctggcgtccgaggcatggatggtccccagggccccaaagggagcttgggaccccagggagagccaggacctcctggacaacagggcacccctgggacccagggtcttcccgggccccagggngccatcggccctcatggagagaagggtcctcaagggaagccagggctccccggcatgcctggctcagacggacccccgggtcacccagggaaggaaggtccccctggaaccaaaggaaaccaggtccctctggacctcagggacctctaggatacccaggacctcnaggggtcaagggtgtgnacggaattcggggtctgaagggtcataagggtgagaagggtgaggatggctttcctgggttcaaaggtgacataggcgtgaaaggtgacaggggcgaagttggagtccctggttccaggggagaggatggtcctgaggggccaaagggacgcactggaccgactggagaccctgggcccccagggctcatgggcgagaagggcaagctgggtgttcctggtctgcctggctatcctggacgtcagggacccaaggggtccctaggatttcctggctttcctggtgccagtggagagaagggagcccggggcctgtcggggaagtcagggcctcggggagaacggggccccacgggtccacgggtcagcggggaccccgaggtgccactgggaagtctggagctaagggaacatctggtggtgatggcccccatggnccccctggagagaggggcctccctggacctcaggntccaacgggtttcctggaccgaaaggacccccgggnccccctgggaaggangggctgccgggacacccaggccaaagaggagaagtgggtttccaagggaagaccggcccccctggtcctccaggagtggtgggacctcagggagcagcaggagaaaccggccctatgggggagagaggtcacccaggccccccggggccccctggagagcagggactacctgggacagctggaaaagaaggaacaaagggtgaccctggtccccctggggccccagggaaggatggtcctgctggtctgaggggattcccaggagagagaggcctcccaggcactgctggtggacctggtttgaaggggaatgaaggtccgtctggcccccctggccctgcaggctcccctggggaacgaggtgcagcaggatcagggggacccattggtcgccagggcgcccaggcccgcagggtccccctggagcagcaggagagaaaggtgtcccaggtgagaagggccccattggcccgactggccgagatggagtgcagggtcctgtggggcttcctggtcctgctgggcctccaggtgtggctggagaggatggagacaagggtgaggtgggggnncccggacagaagggcaccaaagggaacaagggtgaacatggccctcctggaccccctggacccattggncctgtggggcagcctggagcagcgggannagatggggagccggagctcgggacccagggacactttggagccaaaggtgatgaaggaacaagaggattcaatgggcccccaggacccattggcctacagggtttgccaggcccctctggggagaagggagaaacaggagatgtgggtcctatgggaccacctggccccccaggacctcgaggtccagctggacccaatggcgctgatggcccacaaggtcccccaggaggtgttgggaacctgggtccccctggagagaagggggaaccaggagagtcaggatctccagggatccagggcgagccaggtgtcaagggtccacgcggggaacgtggagagaaaggagagtcggggcagccaggagagccagggccaccagggcctaaaggccccacaggcgatgatggccccaaagggaaccctggtcctgttggttttcctggtgaccctggcccccctggagaaggtggccctcggggccaggatggtgctaagggtgaccgaggcgaggatggtgagccaggacagcctggatcccctggtcccaccggggagaatggacccccagggccacttggaaagcgaggtcctgctggctcgcctggttccgaggggcgacaaggagggaagggagccaagggagatcctggcgctataggtgccccggggaagacaggcccggtgggtcctgcaggcccagcagggaaacctggccctgatggtctgagggggctcccaggctcagtgggtcagcaaggccgacctggagctacaggccaggctgggcccccaggtcctgtgggacccccagggctgcctggtctccggggcgatgctggagccaagggagagaagggccacccaggtctcattggactgattgggcccccgggtgagcagggagagaagggagatcggggacttcctgggcctcagggctcccctgggcagaagggtgagatgggtatcccaggagcatccggccccattggtcctggaggtccccccggcctccccggacctgctggccccaaaggagccaaaggagccacaggcccaggcggacccaagggagagaagggtgtgcagggccctccaggacacccgggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcggnaggagatcgagcagatgaggcggccaacagggacccaggacagccctgctcgcacctgccaggacctgaagctgtgccacccagagcttcccgatggagagtactgggtcgaccccaaccagggctgtgctcgggatgccttccgagttttctgcaacttcacagcagggggtgagacctgtgtgacgcctagggatgacgtcacgcagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcaaaagtgtctg

SEQ ID NO: 323370 - DNA, 1136 bp, Homo sapiens
  misc_feature (79)..(79): n is a, c, g, or t
cccctgtggatgtgctccgggccctgaggttcccctccctccctgatggtgtccggagagcgaaaggcatctgtccagntgatgtggcctaccgagtggcacgacctgcccagctcagtgcacccactcgccagcttttcccaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaatttgtggctgggagctgtgttccctgctctgcgtctcctcttccagtcttcctggaactgtgtccctgggttttcccttccttctttgaattaagagattgggagacagtgggagaggggtgagagctggggaggcaggtaggagaggggactgaagccaggagaaagcagtcgggatggtgagaccaaggaggaggaatgggaaggagtagggatggagggaatatcaaaggaggggtgggtc

SEQ ID NO: 323371 - DNA, 404 bp, Homo sapiens
gagagagagagtagagagagagagagagagagagagagagagagtgcgagatatagagattgcccacccggctcctccacccctctggaggccatgaaaggacccagggaagagatcgtctacctgccctgcatttaccgaaacacaggcactgaggccccagattatctggccactgtggatgttgaccccaagtctccccagtattgccaggtcattgagcccaaggacatccatgccaagtgcgaactggcctttctccacaccagccactgcctggccagcggtgcgtttcgattcatctcctggtagacgtcatgttcttggctatttttctttgtgctatttgatttctgtcttttttcttttctgtttatcctctttcctttctgttttgtctttgc

SEQ ID NO: 323372 - DNA, 2861 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgaggtgacatacgccctctggccctcccctcccagtagtcttgtcagcagctctacctaagcaggcttctgtaacggtgctcccaggcgtctccaggaacgaaaaaaatgaggctgcatgccctgtctctcttctctcagtgctagggcaacttctgcctgaaccctaactggccgtatttattcattcattcaaaaactacttagtgaatgtctgtgctaggcactgtgctatgttctgggaatgcagtggtgaagcagacacaacccctgcctcaaggggcttgcatggagttagatcctgctggcaagaaggccgggcatctattctctccctcccaggtctgggcaacccagatctaacccctagtccccaattctgataggctgacctctctgccagctaacctcaccctccacccctcaatgtagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacaggtggagaccctggcaggaggagcagaagggaaggaaggaaagagaagagaagctggggatggggtggatgatctgaagcagctgcaggatgttgagggaggtgcaggaaaagcagacatgtgtgctgtgggacagcacaggcccaggactgtccaggccagggatgggcatgcagagcatgtctgaaaggagagaggggttccagccaggcaagctgctcttcctgcaatgtttgcgcctcccactatggtcctccttatactctgcacctccccatctagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323373 - DNA, 1606 bp, Homo sapiens
acttgaggcagtggctggtgtggagaaaggccagttcgcacttggcatggatgtccttgggctcaactgaccttgttgcagctttgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323374 - DNA, 2098 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323375 - DNA, 1224 bp, Homo sapiens
gcgtaggatcatgcgtctggtggctcggggaccacggtacgtagaggtggaagcgagtgagtctgtaactagaccccgtagggatgatcgctggcgtctatgagctagttgcttgctgttcatccaccacattaaaaaacggccggggatcaaccgatgcgtgctgagcatcatccatgatgttactactagtgggttataactggatgtatgctaggaggcagtccatgtcgcagctacgacatctatatgatcgtggcactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323376 - DNA, 2343 bp, Homo sapiens
  misc_feature (2207)..(2207): n is a, c, g, or t
  misc_feature (2209)..(2209): n is a, c, g, or t
  misc_feature (2215)..(2215): n is a, c, g, or t
  misc_feature (2245)..(2245): n is a, c, g, or t
  misc_feature (2252)..(2252): n is a, c, g, or t
  misc_feature (2264)..(2264): n is a, c, g, or t
  misc_feature (2269)..(2269): n is a, c, g, or t
  misc_feature (2273)..(2273): n is a, c, g, or t
  misc_feature (2276)..(2276): n is a, c, g, or t
  misc_feature (2283)..(2283): n is a, c, g, or t
  misc_feature (2298)..(2298): n is a, c, g, or t
  misc_feature (2306)..(2306): n is a, c, g, or t
  misc_feature (2309)..(2309): n is a, c, g, or t
  misc_feature (2314)..(2314): n is a, c, g, or t
  misc_feature (2316)..(2317): n is a, c, g, or t
  misc_feature (2319)..(2319): n is a, c, g, or t
  misc_feature (2322)..(2322): n is a, c, g, or t
  misc_feature (2327)..(2328): n is a, c, g, or t
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttcaaaaaaaaaaaaaaaaaaaaaaaaaaaaaaaaaaaaaaaaaaaaaagaaaaaaaananaaaaanaaaaaaaaaaaaaaaaaaggggggggggcnaaaaatncccccggggggnccatncccnccngtttttnttggaaaaagggggncccccaanagngaggngnngntanaaaannaacagaaggacggcg

SEQ ID NO: 323377 - DNA, 741 bp, Homo sapiens
gaggatccccactgtacggcgacgtggtgatgtagaggcgcttcccatccaggctgagctggatcatctgagggcctccagccacccgttttcccttgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323378 - DNA, 2098 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323379 - DNA, 2100 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacaagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323380 - DNA, 1944 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323381 - DNA, 1524 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323382 - DNA, 545 bp, Homo sapiens
gccctcccctcccagtagtcttgtcagcagctctacctaagcaggcttctgtaacggtgctcccaggcgtctccaggaacgaaaaaaatgaggctgcatgccctgtctctcttctctcagtgctagggcaacttctgcctgaaccctaactggccgtatttattcattcattcaaaaactacttagtgaatgtctgtgctaggcactgtgctatgttctgggaatgcagtggtgaagcagacacaacccctgcctcaaggggcttgcatggagttagatcctgctggcaagaaggccgggcatctattctctccctcccaggtctgggcaacccagatctaacccctagtccccaattctgataggctgacctctctgccagctaacctcaccctccacccctcaatgtagggaggtacatggtcagtggagaaggtgatccaggtgccccccaagaaagtgaagggctggctgctgcccgaaatgccaggtgagtgcctagggcataggaaagttgattcttggcctgggaaacaagagtcctt

SEQ ID NO: 323383 - DNA, 1279 bp, Homo sapiens
gaatgaaataagacaaaccatcaggcttgctgtattgtaaaccaacacaatatagttataacagatctgtagaaggatccttagaataagagagtcatttgtcgggggtcatcagggagaatactgatagtatcttcggctttgccgcataacagacacagcatggtatactcgatcataggtaactatttcttctccatcttcttctttcaaggatttgtttgtgatcagcataaaatcccgcttactgcacactgcacagcctgtaaagttcagtaagaaagatccattctccaggcaggtattaccccggttgggatattccttctccacacagtcgccacacatcgcgacgcagtcaacagggaatgtcctccatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323384 - DNA, 2152 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323385 - DNA, 2420 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggtgagaatccccccatgtgccagcaggagccttgggcctacatccccttgctttctgctccaaatctcccacccccacacttccctcctgtggccccagaatctaagagagatggcataggatgtaccgcatgctcagattgctcaagcgtcttcctgatccctccaatccatttcttaaccttctgccctgattggtggcccagtctttgcccatgccttccaacctctgatgctgagcctatcctccggccccactcccaccccaggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323386 - DNA, 2848 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggtgagaatccccccatgtgccagcaggagccttgggcctacatccccttgctttctgctccaaatctcccacccccacacttccctcctgtggccccagaatctaagagagatggcataggatgtaccgcatgctcagattgctcaagcgtcttcctgatccctccaatccatttcttaaccttctgccctgattggtggcccagtctttgcccatgccttccaacctctgatgctgagcctatcctccggccccactcccaccccaggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgaggtgacatacgccctctggccctcccctcccagtagtcttgtcagcagctctacctaagcaggcttctgtaacggtgctcccaggcgtctccaggaacgaaaaaaatgaggctgcatgccctgtctctcttctctcagtgctagggcaacttctgcctgaaccctaactggccgtatttattcattcattcaaaaactacttagtgaatgtctgtgctaggcactgtgctatgttctgggaatgcagtggtgaagcagacacaacccctgcctcaaggggcttgcatggagttagatcctgctggcaagaaggccgggcatctattctctccctcccaggtctgggcaacccagatctaacccctagtccccaattctgataggctgacctctctgccagctaacctcaccctccacccctcaatgtagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323387 - DNA, 2297 bp, Homo sapiens
  misc_feature (2199)..(2199): n is a, c, g, or t
  misc_feature (2206)..(2206): n is a, c, g, or t
  misc_feature (2218)..(2218): n is a, c, g, or t
  misc_feature (2223)..(2223): n is a, c, g, or t
  misc_feature (2227)..(2227): n is a, c, g, or t
  misc_feature (2230)..(2230): n is a, c, g, or t
  misc_feature (2237)..(2237): n is a, c, g, or t
  misc_feature (2252)..(2252): n is a, c, g, or t
  misc_feature (2260)..(2260): n is a, c, g, or t
  misc_feature (2263)..(2263): n is a, c, g, or t
  misc_feature (2268)..(2268): n is a, c, g, or t
  misc_feature (2270)..(2271): n is a, c, g, or t
  misc_feature (2273)..(2273): n is a, c, g, or t
  misc_feature (2276)..(2276): n is a, c, g, or t
  misc_feature (2281)..(2282): n is a, c, g, or t
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttcaaaaaaaaaaaaaaaaaaaaaaaaaaaaaaaaaaaaaaaaaaaaaagnaaaaatncccccggggggnccatncccnccngtttttnttggaaaaagggggncccccaanagngaggngnngntanaaaannaacagaaggacggcg

SEQ ID NO: 323388 - DNA, 2297 bp, Homo sapiens
  misc_feature (2161)..(2161): n is a, c, g, or t
  misc_feature (2163)..(2163): n is a, c, g, or t
  misc_feature (2169)..(2169): n is a, c, g, or t
  misc_feature (2199)..(2199): n is a, c, g, or t
  misc_feature (2206)..(2206): n is a, c, g, or t
  misc_feature (2218)..(2218): n is a, c, g, or t
  misc_feature (2223)..(2223): n is a, c, g, or t
  misc_feature (2227)..(2227): n is a, c, g, or t
  misc_feature (2230)..(2230): n is a, c, g, or t
  misc_feature (2237)..(2237): n is a, c, g, or t
  misc_feature (2252)..(2252): n is a, c, g, or t
  misc_feature (2260)..(2260): n is a, c, g, or t
  misc_feature (2263)..(2263): n is a, c, g, or t
  misc_feature (2268)..(2268): n is a, c, g, or t
  misc_feature (2270)..(2271): n is a, c, g, or t
  misc_feature (2273)..(2273): n is a, c, g, or t
  misc_feature (2276)..(2276): n is a, c, g, or t
  misc_feature (2281)..(2282): n is a, c, g, or t
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttcaaaaaaaaananaaaaanaaaaaaaaaaaaaaaaaaggggggggggcnaaaaatncccccggggggnccatncccnccngtttttnttggaaaaagggggncccccaanagngaggngnngntanaaaannaacagaaggacggcg

SEQ ID NO: 323389 - DNA, 764 bp, Homo sapiens
ctgcacgaagtgcaacattaagatccacgagacacagccactgctcaacctcaaactggaccgggtcatgcaggacatcgtgtatagctggtgcctggcttgcaagacagtgaagagaaacggattcgggaattctaccagtcccgaggtttggaccgggtcacccagcccactggggaagagccagcactgagcaacctcggcctccacttcgtgggcagcgctgcccacgaagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323390 - DNA, 1834 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagcgagcggggtccgctcggaccagggcacctatgaggattatgtcggaggacttcgggtgtttgacaaggaaggaaatggcaccgtcatgggtgctgaaatccggcatgttcttgtcacactgggtgagaagatgacagaggaagaagtagagatgctgtggcagggcatgaggacagcaatggttgtatcaactatatgagct

SEQ ID NO: 323391 - DNA, 1257 bp, Homo sapiens
tcccttcgctccttagcggggaacagcggcctctgacaccagcacagcaaacccgccgggatcaaagtgtaccagtcggcagcatggctacgaaatgtgggaattgtggacccggctactccacccctctggaggccatgaaaggtaattgcccatggtctgagagccagcgccctactactgattccacagctgggggtggagggacttcagacctagcccccaccctctggcacacccagcacttcccctacctttccttcccaccctgccgtccctgctgcctgctttctaccgtgcaggacccagggaagagatcgtctacctgccctgcatttaccgaaacacaggcactgaggccccagattatctggccactgtggatgttgaccccaagtctccccagtattgccaggttaggcggggcttgggcgccagctactttgagaccatagctgccctcatccctggccctgggcccccccttcccagctccatccttcttggccctccctggggatgcttgtgcacgctcaacctgggacaaggggagtgctgaaatccagcctgtgccgtgcttccaaaccaaaatgagtccacaggggcgcctcttccaaaagtggacagaggcgtggcctgggggagcaccacctctccccgcatcctaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggccttttccaccatccagcgcttctacaagaacgagggaggtacatggtcagtggagaaggtgatccaggtgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 323392 - DNA, 6110 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323393 - DNA, 5570 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtgaggaatggctccaggacacgtccctttactctgccaagatcaactcaaaagaccacaactgtttcatgatgctggtgaatacacaattctgtatggcactcactgatactgtcacctgagaggaagacgggggaagagacagagtatgggcttaaagaaacaagactgtataataaatacagattaaaaaagaaaaatcgccaccatctcccctgttggcctgattaccccgatcctgctatgtaacacagcaatccctcccctggagaccagaggggcttggcactgtggtggaagccagaacgagcaggcccttaggaaagaaggcaggaacaggaactggcttcaccagaaaagctagaccctcggactcctcctggaaactctcagaagggagggttatggccctctttgtcccttcatatttctggacaaagaccaccaacccaatatcaagccccataaagagcttttagaaaaacagcataagcttgggatgacaggcgtttctggactccctgtgatctcttccaggttcttggtcttcctcgctcgcctccctcccaccctccctagctgtccccccacctcagctcccttaccacggccctgcctctctacttcttctgtcttcgtcccctggactgtccaacggcctctggctcactgtcccttcatcttcagcaacctatcaggaaacttcttgcgcttcctgcggacatatgggtggccaggaagtgtttatgcaaca

SEQ ID NO: 323394 - DNA, 673 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggagtatccttttccagccgcgcgggccgggctgggccgggctgggccggggtagggcctggggctcgcgagaccaggtcagccgcgcatccccggcccggggcagctgtcagcgcgccccggccgctcgcgggcctggaggctgagtctcagcctgcgcccgccgatccttccaggggatccggcggggggcgcgcaccggccctggaaggagaag

SEQ ID NO: 323395 - DNA, 6679 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtagatgtgaagcttaaaaagagatcagtgaagcaggaggatcgcttcaggccaggagtttgagaccagcctgcgcaacatagtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323396 - DNA, 3975 bp, Homo sapiens
cgctgccgtaagggacacagcagtaataggatactgagcatctggtaaaagtagcccagaataacagctcaagaattccaccaccatggccacatccccaaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323397 - DNA, 1462 bp, Homo sapiens
aattcgcggccgcgtcgacacggtgcgagaagacgacagaagggatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323398 - DNA, 1848 bp, Homo sapiens
  misc_feature (42)..(42): n is a, c, g, or t
  misc_feature (58)..(60): n is a, c, g, or t
  misc_feature (111)..(111): n is a, c, g, or t
  misc_feature (129)..(129): n is a, c, g, or t
  misc_feature (131)..(131): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (160)..(160): n is a, c, g, or t
  misc_feature (163)..(163): n is a, c, g, or t
  misc_feature (200)..(200): n is a, c, g, or t
  misc_feature (205)..(205): n is a, c, g, or t
  misc_feature (208)..(208): n is a, c, g, or t
  misc_feature (226)..(226): n is a, c, g, or t
  misc_feature (240)..(240): n is a, c, g, or t
  misc_feature (266)..(266): n is a, c, g, or t
  misc_feature (270)..(270): n is a, c, g, or t
  misc_feature (272)..(272): n is a, c, g, or t
  misc_feature (275)..(275): n is a, c, g, or t
  misc_feature (280)..(280): n is a, c, g, or t
  misc_feature (283)..(283): n is a, c, g, or t
  misc_feature (286)..(286): n is a, c, g, or t
  misc_feature (301)..(301): n is a, c, g, or t
  misc_feature (312)..(312): n is a, c, g, or t
  misc_feature (326)..(326): n is a, c, g, or t
  misc_feature (330)..(330): n is a, c, g, or t
  misc_feature (345)..(345): n is a, c, g, or t
  misc_feature (349)..(349): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (374)..(374): n is a, c, g, or t
  misc_feature (386)..(386): n is a, c, g, or t
  misc_feature (402)..(402): n is a, c, g, or t
  misc_feature (408)..(408): n is a, c, g, or t
  misc_feature (413)..(413): n is a, c, g, or t
  misc_feature (442)..(442): n is a, c, g, or t
  misc_feature (444)..(444): n is a, c, g, or t
  misc_feature (450)..(450): n is a, c, g, or t
  misc_feature (456)..(456): n is a, c, g, or t
gttcaactcctaactgcggcggaaacgtgggagccgcgcggngccgctgtcgtcccannncccgccgccctcgtcgcgcgcggggcctccgcgcccccggctgctgctcangccccgcccgggagccanantttgtggaagtanaanantttgtcattanganatgtcgtctctcggtgcctcctttgtgcaaattaaanttganganttgcagttttttgaaaantgcggtggaagaanttttgggagtgtttatcgagccaaangganancanaaganaangangtggctgtaaaaaanctcctcaaaanaaaaaaaaaagcanaaanaatcaatgtcctcantcanaaaaanancanccaattttatggantaattcttgaanctcccaactatggcantgtcanaaaanatgcttctctgggatcactctatgattanantaacantaacanaagtgggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323399 - DNA, 5679 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323400 - DNA, 4791 bp, Homo sapiens
  misc_feature (4467)..(4467): n is a, c, g, or t
  misc_feature (4496)..(4496): n is a, c, g, or t
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtacccccccccccgggggcttcagctggcccttcagggagcctngtgaccaaagggaaagattgaacgggggncccccgggaaaagggggggaaaaaccttttaaaccctcttttaaacgttttggcaaactttttggggtttttggggaactacaacgcaccccccccaaagttgggggcatccttttccacgaacagttgccatgaaacaaaattgttacctgtgggagctaccgctctgtgaccacggggggaaaggttttctttttaacctgacattggcaacaaagggggccccaaaaaaaaggtggtttttttaaccccaaattgggcccttttttggggcaaaagggggggatttttttac

SEQ ID NO: 323401 - DNA, 367 bp, Homo sapiens
tacaggcgtgagccactgcacccggccagtcaagtacttttaaatgcatgagccatgcagtgaactgaggagcacagttaaattaatggtatgtggctctcgattttgtttaatgaatgttatgtggcatttgagtctagatttatttgaatttgaggttggattcctttcgtcttcctctgggccttttctcagtctggttttaaaatcctttcctataggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgagga

SEQ ID NO: 323402 - DNA, 6078 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattcagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323403 - DNA, 6597 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323404 - DNA, 6687 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccaaaaaaaaagggggggggctaaaatactgggggccaagttagggtccaggtttgtcccagggccaaggggcggaaaaagaggaggggggta

SEQ ID NO: 323405 - DNA, 4280 bp, Homo sapiens
gcaatgagtgtgaagactgaacttaacattttcataattaatccggacgagactggtcatagatagggccatccctgtagatgatggcactaatagtttttcaccaggtaagtcccaagtaaagagaataaacagtaagatctttcaaggttctaggaagagacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323406 - DNA, 5970 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaacca

SEQ ID NO: 323407 - DNA, 5474 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattccaggatcgtgcacgcgactgggcagatcacagggatacatcatagagacagccag

SEQ ID NO: 323408 - DNA, 3972 bp, Homo sapiens
cgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaagaaagaaaaagatgaagaaaggaagaagaataaggaagaagaagaaagagaagaaagaagaagaaaaggaagaagaggaagaaagaagaaggaagaagaagaaaggaagaactaagaagaagaagaggaaagaagaagaaaaagaagatagaagatggaagaagaaagaaaagaaagaagaataagaag

SEQ ID NO: 323409 - DNA, 599 bp, Homo sapiens
  misc_feature (8)..(8): n is a, c, g, or t
ggcgtggngaatcggcacgagggcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323410 - DNA, 994 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaaaactccggggcttttttttgggggggggaaaaaagggtataaagggcaggggcatgggtttcggaccccgttttcgggtcacagggggtacatcgccgggtcccgcaaaagagaagccggcataattgcaaaaggcagttacctgctagattgtgcgccgaaacgaacgacgaagcacaagacaacacagaacagaacaaccaacacgcaagacagcagaagcaaagcagaacacagacaagagcaaaggacagagaagcaagaacacaggaacacgacgagcagagacagagagaagagacgagcgcaagacacacaaacacgcatcaacacatcaggcgcaaaatg

SEQ ID NO: 323411 - DNA, 592 bp, Homo sapiens
atcatggcgcaggagtgtggtcgtatgtggaggtcgcttgtcgttgatggtagaggcggcccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323412 - DNA, 632 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323413 - DNA, 628 bp, Homo sapiens
taaggccctcggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323414 - DNA, 879 bp, Homo sapiens
ggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgctctgctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323415 - DNA, 809 bp, Homo sapiens
  misc_feature (18)..(20): n is a, c, g, or t
  misc_feature (725)..(725): n is a, c, g, or t
  misc_feature (748)..(748): n is a, c, g, or t
  misc_feature (775)..(775): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaacaaaaaaaaaacaaaaaaaaaaaaaacggggggttttattgggggggggggaaaaaggggtttggaaggggcctgggcataggngttccgggccccgtttttttgtncaagggggaaaatgggggggcccccangggggggggaataatcagaggccggtctgcatcc

SEQ ID NO: 323416 - DNA, 822 bp, Homo sapiens
  misc_feature (288)..(288): n is a, c, g, or t
gttcgtttaccatccgcagctttccaaacatttttcccttttctgggtccttacaccaaatggtttcatagcaccgatttttctctcctttatcccctccttcttttttttatcttctgtggccctcttactacatggtggaacttatttgcctctgtttttttatacgccccccttttttgtttttatagtgtttcgtgctgctatattatttctcattgttttgttactgatcatcatttagctgcttttttttttttttttttttagtttgagggggaatctggnacccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323417 - DNA, 603 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatcc

SEQ ID NO: 323418 - DNA, 1241 bp, Homo sapiens
ggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgctctgctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaaaactccggggcttttttttgggggggggaaaaaagggtataaagggcaggggcatgggtttcggaccccgttttcgggtcacagggggtacatcgccgggtcccgcaaaagagaagccggcataattgcaaaaggcagttacctgctagattgtgcgccgaaacgaacgacgaagcacaagacaacacagaacagaacaaccaacacgcaagacagcagaagcaaagcagaacacagacaagagcaaaggacagagaagcaagaacacaggaacacgacgagcagagacagagagaagagacgagcgcaagacacacaaacacgcatcaacacatcaggcgcaaaatg

SEQ ID NO: 323419 - DNA, 599 bp, Homo sapiens
taaggccctcggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatcc

SEQ ID NO: 323420 - DNA, 890 bp, Homo sapiens
  misc_feature (858)..(858): n is a, c, g, or t
ggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgctctgctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaacagtgaatactgctacagtggcggggcaaatgcctgcatccatagttgggagattccggacctcagcatggattcctaagatggntacgacccaagcgtgctgagccacgtcctgga

SEQ ID NO: 323421 - DNA, 397 bp, Homo sapiens
  misc_feature (11)..(11): n is a, c, g, or t
acccacgcgtncgcccacgcgtccgcggacgcgtgggtcgacccacgcgtccgcgacccacgcgtccggaagggtctaagtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323422 - DNA, 539 bp, Homo sapiens
gaggatatggtgcagaaggtgcacagccacagcgccgagatggaggctcagctgtcgcaggccctggaggagctgggaggccagaaacaaagagcagacatgctggagatggagctgaagatgccgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323423 - DNA, 450 bp, Homo sapiens
gcccccatacctgagaggatccgcacacttctggagctggagaaggcagagcgtcacgggagtcgggctcgggccgggccctggagaggcggcggcggcggaaggtggatcggggtggggagggcgatgacccagcccgagaggagctagagccaaagagggtacggagctcagggccagaggctgaggaggtccaggaggaggaaaagctggaggaggagactgggggtgagggcccccctgcacccatccccaccactggcagtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323424 - DNA, 331 bp, Homo sapiens
gaccctggtgagctgggtggccttaacagcagggctggtggctggaacgcggtgcccagatggtcagttctgccctgtggcctgctgcctggacaccggaggagccagctacagctgctgccgtccccttctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323425 - DNA, 412 bp, Homo sapiens
atcatggcgcaggagtgtggtcgtatgtggaggtcgcttgtcgttgatggtagaggcggcccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccacgctacacgtatgaatcctgggtcatcacagatacagcatacgactcatgattacgactggacgttctgtatc

SEQ ID NO: 323426 - DNA, 617 bp, Homo sapiens
gcggccgcctactactactaaattcgcggccgcgtcgacggcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323427 - DNA, 802 bp, Homo sapiens
tagctgggacctggatttgctttcctttatccgtcgccatccatggcaggccgagcctgcgggggctacttcgcccgcagcccgaggaatatggagcccgcaatgcctgctggcccaaaactagcagagccgttcgagccaaggacgcagggttgaattctgtcactttccctgccatcgttttaggagcggctccgggcacttgcccggagtgctcagaagcacgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323428 - DNA, 1013 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaacaaaaaaaaaaaagaagagcgggcgcgcgcgcgcgcgcgccccgcggccccgcgaaagagcttcccaagacccgcggggggggggcgcgcgcgggccccatagtggaactgcaggtagacacgtggcacaaaaacagctgctatcaccaaaagagaaagccccgggacacaaagacacagggcggcgtggggaccaccaccaacacaaaacaacaacagagcgccgcgcgcggggacacacacgagagcgtgattacaaaaaacaccagcagccgagaatggagagatcccaagagaggcgataacgtggagcacatacatggaacgtgaggattcccaaacgggaagagccacgaagtaagaaacacccgc

SEQ ID NO: 323429 - DNA, 1056 bp, Homo sapiens
  misc_feature (972)..(972): n is a, c, g, or t
  misc_feature (995)..(995): n is a, c, g, or t
  misc_feature (1022)..(1022): n is a, c, g, or t
ggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgctctgctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaacaaaaaaaaaacaaaaaaaaaaaaaacggggggttttattgggggggggggaaaaaggggtttggaaggggcctgggcataggngttccgggccccgtttttttgtncaagggggaaaatgggggggcccccangggggggggaataatcagaggccggtctgcatcc

SEQ ID NO: 323430 - DNA, 965 bp, Homo sapiens
  misc_feature (881)..(881): n is a, c, g, or t
  misc_feature (904)..(904): n is a, c, g, or t
  misc_feature (931)..(931): n is a, c, g, or t
gatgggtttccccgagggtcgcccaccgaaattttaaagcaactttggtaatttaggacctggggtttttagggactcggtggcaagtaataattaaagctccatagggtcttcttctcttgctgtggttatgcccccgccttttcacggccaggtccattttcaactgggttaaaaggtaagagacacctggaccctcgtgcatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaacaaaaaaaaaacaaaaaaaaaaaaaacggggggttttattgggggggggggaaaaaggggtttggaaggggcctgggcataggngttccgggccccgtttttttgtncaagggggaaaatgggggggcccccangggggggggaataatcagaggccggtctgcatcc

SEQ ID NO: 323431 - DNA, 789 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaacaaaaaaaaaaaaaaaaaaaaaaaaaaaaaaaaaaaaaacaaaaaaaaaaacaaccggcggcccgcaccacccccccacccccccccccccccacgcccccccgccccccccccgcgcgcccccaccacgcccgccaccgctgg

SEQ ID NO: 323432 - DNA, 1279 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaacaaaaaaaaaaaaaaaaaaaaaaaaaaaaaaaaaaaaaaagggggggggcgcaaaaaatccccaccggggggcgccccagacatactacgcggcgtacccgccagctctttgtgagacacaggggggcccccataagagaggcgagcgccgcttaaataataaacgctgagaggcagcgcgggcccgcgcgggtttataaaacacagcgctgggcggacgggcgaaacaacgcgtgcaccgggcggaacagcctagggggagaaaggaaccccaacatcggcggggggggggggaaccaatggtgggcaccacacacccctcacgggaattaaagcgacgcgggggagactactacaaacccctggggggggtctacagggggggcaacccccacgaaggccatttcctctcgcggcgtgggaaaaatttcggcgcgccggggagattttcagattccgcggaaccaatatttacagacgaaggagtagagatcagaaacgggtccgcacccgcacactcacacctccagccacgcacaactaacccctgcccgctaacgcagcctcgcacacctcacgctagcaccctcacgagagcatcagcagtccgacaccacacctcaagaccaaccac

SEQ ID NO: 323433 - DNA, 603 bp, Homo sapiens
  misc_feature (52)..(52): n is a, c, g, or t
gtgtttattccccatttctttgagggatcaggaaggaatcctgggtatgccnataacccccctctctgaacccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323434 - DNA, 776 bp, Homo sapiens
  misc_feature (18)..(20): n is a, c, g, or t
  misc_feature (646)..(647): n is a, c, g, or t
  misc_feature (656)..(656): n is a, c, g, or t
  misc_feature (680)..(680): n is a, c, g, or t
  misc_feature (699)..(700): n is a, c, g, or t
  misc_feature (717)..(717): n is a, c, g, or t
  misc_feature (719)..(720): n is a, c, g, or t
  misc_feature (728)..(728): n is a, c, g, or t
  misc_feature (733)..(733): n is a, c, g, or t
  misc_feature (738)..(739): n is a, c, g, or t
  misc_feature (750)..(750): n is a, c, g, or t
  misc_feature (753)..(754): n is a, c, g, or t
  misc_feature (756)..(756): n is a, c, g, or t
  misc_feature (766)..(766): n is a, c, g, or t
  misc_feature (768)..(768): n is a, c, g, or t
  misc_feature (770)..(770): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaagaaaaaaaaatatnnaaattatanttaataataaaaaaaaaaaaaaanctgaggggggcccggtccnnattcgcctatagggagngnnttacattnactgnccggnntttaacaacgnggnncnggggaaaccntngngttccc

SEQ ID NO: 323435 - DNA, 789 bp, Homo sapiens
  misc_feature (18)..(20): n is a, c, g, or t
  misc_feature (705)..(705): n is a, c, g, or t
  misc_feature (728)..(728): n is a, c, g, or t
  misc_feature (755)..(755): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaacaaaaaaaaaaaaaacggggggttttattgggggggggggaaaaaggggtttggaaggggcctgggcataggngttccgggccccgtttttttgtncaagggggaaaatgggggggcccccangggggggggaataatcagaggccggtctgcatcc

SEQ ID NO: 323436 - DNA, 709 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaacaaacctggagtccccactataggccctgcgtacctttgttttcccagttggcttatctgaaaagacaaataa

SEQ ID NO: 323437 - DNA, 1359 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaagaaatgtgcaattctgttgtgtgttctgtgaaaggatcctggccatattcaagtccttggacctcaagccacttaaagcttcgatgggagtagctggtaacaaccccgtcatcctctgattggatgccagtatttcctggcagatccaagtccaagcttcatagcattcattgcctgtgcttgccacaccttggttgatgtgctgtggtgcagtagccccatttggaagggagggtttggttgatgttggggtttgaatttagagccttgattaagcagggtgcagtgctcctgtgttccaggaggccccctgctattcagtgattctgttctgtactagaaattttatcagcattgatgcgtcatgaaggaatgacaggctttggtgtgatggttgagattaaatttagacttaactgttcaggctcaggtttcttttacaatgagagtataaggttcttgggaggcagtatgtgcagataagagggcagtctttccgtttccagccctttcctttaactgttacctcgggtgagttgttaatctgcctcagtttccttatctgtatcaggaggcagtaatagtagtatctctcagaggattaaatgatttaatacttaacaaaatgctcagactagcaccagccacgtagtgctcaaaaggggtttcatttttgtgtttgggtataagaaatattacttctgctagcttgcttccctttggtgca

SEQ ID NO: 323438 - DNA, 743 bp, Homo sapiens
  misc_feature (18)..(20): n is a, c, g, or t
  misc_feature (647)..(647): n is a, c, g, or t
  misc_feature (666)..(667): n is a, c, g, or t
  misc_feature (684)..(684): n is a, c, g, or t
  misc_feature (686)..(687): n is a, c, g, or t
  misc_feature (695)..(695): n is a, c, g, or t
  misc_feature (700)..(700): n is a, c, g, or t
  misc_feature (705)..(706): n is a, c, g, or t
  misc_feature (717)..(717): n is a, c, g, or t
  misc_feature (720)..(721): n is a, c, g, or t
  misc_feature (723)..(723): n is a, c, g, or t
  misc_feature (733)..(733): n is a, c, g, or t
  misc_feature (735)..(735): n is a, c, g, or t
  misc_feature (737)..(737): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaaanctgaggggggcccggtccnnattcgcctatagggagngnnttacattnactgnccggnntttaacaacgnggnncnggggaaaccntngngttccc

SEQ ID NO: 323439 - DNA, 695 bp, Homo sapiens
  misc_feature (18)..(20): n is a, c, g, or t
  misc_feature (634)..(635): n is a, c, g, or t
  misc_feature (667)..(667): n is a, c, g, or t
  misc_feature (671)..(671): n is a, c, g, or t
  misc_feature (681)..(681): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatnnttgctcttttggatagaaacggtcgacgcggncgcnaatttagtantagtaggcggctgc

SEQ ID NO: 323440 - DNA, 699 bp, Homo sapiens
  misc_feature (18)..(20): n is a, c, g, or t
  misc_feature (635)..(635): n is a, c, g, or t
  misc_feature (680)..(681): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaanaaaaaagtcgacgcggccgcgaatttagtagtagtagtaggggcnnctaggatccaagttacta

SEQ ID NO: 323441 - DNA, 1255 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaacacaaaaaaaaaatcacacaaaaaaacaacttgtgggcgcaaaggacccagaaaaaatttataaaacaccactcctatgtggcgccgcggctccccaaaaagaaccagagacacaggaggacacacaagcgagtatcacacagagcaccccccggaacagaaacaagaacgacgagaatccaccaccaaaataaaatagcccccggccgtaacaccgacagcttcagctgaaacaaaaccccaagcaagtaggagcacgaagaagacaacatagcggcacataatacacaaaggcgaagcacacagaacggtaatcgagataataaaatttaaacccccggatcgatgattaaattatataagttatcatagaacaaaataagaaggacgataaaaaaatataatatacatagatgttaggacagaatgaaagtaataattctttatagtataggtaataaagaagtaagaaataaatagaatagtaagaaaaataagttaggagaacaattagatacataagaagcagaatttaaatagatagatacgagataaaaaatgatttaatagataataagattttataatatatgaatcttatgaaaaaaattaatagaaataac

SEQ ID NO: 323442 - DNA, 785 bp, Homo sapiens
taaggccctcggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaacaaaaaaaaaaaaaaaaaaaaaaaaaaaaaaaaaaaaaacaaaaaaaaaaacaaccggcggcccgcaccacccccccacccccccccccccccacgcccccccgccccccccccgcgcgcccccaccacgcccgccaccgctgg

SEQ ID NO: 323443 - DNA, 743 bp, Homo sapiens
  misc_feature (8)..(8): n is a, c, g, or t
  misc_feature (613)..(614): n is a, c, g, or t
  misc_feature (623)..(623): n is a, c, g, or t
  misc_feature (647)..(647): n is a, c, g, or t
  misc_feature (666)..(667): n is a, c, g, or t
  misc_feature (684)..(684): n is a, c, g, or t
  misc_feature (686)..(687): n is a, c, g, or t
  misc_feature (695)..(695): n is a, c, g, or t
  misc_feature (700)..(700): n is a, c, g, or t
  misc_feature (705)..(706): n is a, c, g, or t
  misc_feature (717)..(717): n is a, c, g, or t
  misc_feature (720)..(721): n is a, c, g, or t
  misc_feature (723)..(723): n is a, c, g, or t
  misc_feature (733)..(733): n is a, c, g, or t
  misc_feature (735)..(735): n is a, c, g, or t
  misc_feature (737)..(737): n is a, c, g, or t
ggcgtggngaatcggcacgagggcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaagaaaaaaaaatatnnaaattatanttaataataaaaaaaaaaaaaaanctgaggggggcccggtccnnattcgcctatagggagngnnttacattnactgnccggnntttaacaacgnggnncnggggaaaccntngngttccc

SEQ ID NO: 323444 - DNA, 1051 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtggtgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccgtttctatccaaaagagcaataaaaagttttcagtgaaa

SEQ ID NO: 323445 - DNA, 1067 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtggtgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccgtttctatccaaaagagcaataaaaagttttcagtgaaa

SEQ ID NO: 323446 - DNA, 619 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctgagcaataatttacgcgcgatccaaaggagcataagttcttttgtttttttttctgt

SEQ ID NO: 323447 - DNA, 1622 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagaattggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttatagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323448 - DNA, 1108 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaacgcaggcggctgaccatgagggtagaacgaaggaagcaggcaagaaggtggggacggacagaggaggaccgcagaagaaaggtgatggtgaaggaaagagggatggagcatgcaagatgagagaagtgaagtcaggatagggggaaagcggtgaagatgacggattgatgaggaatgaacaatgttgagatgcaaggaagcagaagaaccgaagagggatgcactaagaaaaggaacaaaaagggaaaaaggataaaaccagaagacacgaaaaaggggcggcgggacgaaacctatgcaacgcgctcaaaataccacagcacttacagaattcgtaaaaaggagtaggtaacaccatttagagaagtaggagaagggggacacgcagccgagatacaacaacgagtgttaggcaagaaggagccaacacccgaggaagatttgatcaacagagggtagcaacgacgacgcagggaaaggcaagagacaagagagaaatattggagcaaagagaggaagatgaaacaagcagaaaccaccaaacataatcgaagacggacaagagtataagcataaaaaaaagacagacataaaaaac

SEQ ID NO: 323449 - DNA, 2028 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagaattggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttatagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtggtgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccgtttctatcc

SEQ ID NO: 323450 - DNA, 972 bp, Homo sapiens
  misc_feature (845)..(845): n is a, c, g, or t
  misc_feature (904)..(904): n is a, c, g, or t
ggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgctctgctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctgagcaaataaattccccggntttctttttttttttaaaaaaaaaaagggtttttttttttccccgcccaaaagagcaantaaaacacgggggtttttcttttttcccaaaagggggttgggaaaaacaaaaccaaaccaaaacatca

SEQ ID NO: 323451 - DNA, 709 bp, Homo sapiens
  misc_feature (582)..(582): n is a, c, g, or t
  misc_feature (641)..(641): n is a, c, g, or t
cagcggaacaagcaagctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctgagcaaataaattccccggntttctttttttttttaaaaaaaaaaagggtttttttttttccccgcccaaaagagcaantaaaacacgggggtttttcttttttcccaaaagggggttgggaaaaacaaaaccaaaccaaaacatca

SEQ ID NO: 323452 - DNA, 506 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcataagaagcgcagacacggacacgaataaccggtagcgagctcgatc

SEQ ID NO: 323453 - DNA, 572 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323454 - DNA, 525 bp, Homo sapiens
  misc_feature (18)..(20): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323455 - DNA, 616 bp, Homo sapiens
  misc_feature (390)..(390): n is a, c, g, or t
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaagcgggagtatgagttaagatttataggtagaggcgacaaacctaccgagcctggtgatagctggttgtccaagatagaatcttagttcaactntaaatttgcccacagaaccctctaaatccccttgtaaatttaactgttagtccaaagaggaacagctctttggacactaagaaaaaaccttgtagagagagtaaaaaattaacacccatagtaggcctaaaagcagccaccatttaagaaagcgttcaagcctcacacccccttccttaaaaattccaaacatttaacttgaacttctcacacccaattggaccaa

SEQ ID NO: 323456 - DNA, 284 bp, Homo sapiens
ggcatccggagaaatgaaaagattgctgtccactgcacagttcgaggggccaaggcagaagaaatcttggagaagggtctaaaggtgagcctaatcccctaatggagtgatattgatcagcactcctttagtaacacatgtagataagttacatttaatgttctgttctttggtgtcttgatatttatttacttaagcttctaaaaggctttttctacaatcagcagggttaaactgttcttggtggtttaaaagatgcttgaggctgggcacggtggctcaac

SEQ ID NO: 323457 - DNA, 616 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323458 - DNA, 788 bp, Homo sapiens
gatgggtttccccgagggtcgcccaccgaaattttaaagcaactttggtaatttaggacctggggtttttagggactcggtggcaagtaataattaaagctccatagggtcttcttctcttgctgtggttatgcccccgccttttcacggccaggtccattttcaactgggttaaaaggtaagagacacctggaccctcgtgcatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323459 - DNA, 626 bp, Homo sapiens
  misc_feature (21)..(21): n is a, c, g, or t
  misc_feature (26)..(26): n is a, c, g, or t
  misc_feature (35)..(35): n is a, c, g, or t
ttacgggcttaagtcgaggcngggtngaatcggcngaggccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323460 - DNA, 612 bp, Homo sapiens
tggtatgttattttcaattcaacgggcgggcgtctcattgtccattgtcatgccctgtggttttcatattccacgtgtgcccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323461 - DNA, 620 bp, Homo sapiens
ggatcatacatcatgtcgcgggatctatgtgaggtgcagaaccccgaatggctagtaacttggcatactggtcattctggttcacctgtactgcagttggctagagtgaagaggtacagctgccagcctcccatatagtagagatcgatattcactattgcgcatgaccctggtttatccgcatctatgatatcgctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323462 - DNA, 361 bp, Homo sapiens
  misc_feature (297)..(297): n is a, c, g, or t
  misc_feature (342)..(343): n is a, c, g, or t
gcggccgcctactactactaaattcgcggccgcgtcgacggggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaanaaaaaagtcgacgcggccgcgaatttagtagtagtagtaggggcnnctaggatccaagttacta

SEQ ID NO: 323463 - DNA, 293 bp, Homo sapiens
  misc_feature (228)..(228): n is a, c, g, or t
  misc_feature (230)..(230): n is a, c, g, or t
  misc_feature (238)..(238): n is a, c, g, or t
  misc_feature (242)..(242): n is a, c, g, or t
ggctcgttgcgtggctcatagtgtggctcctggagataacagagagccagtctgcagatgctgaacctccacctccccaagagccgcaggctgcattggggccaaacacagaatcagcaaagaggaggccatgcgctggttccagcagaagtatgatgggatcatccttcctggcaaataaattcccgtttctatccaaaagagcaataaaaagttttcagtgaaacncnacgagccncgcnaagagcccacaaagagccacccgacgagccactctaagcgcccgcaacgag

SEQ ID NO: 323464 - DNA, 616 bp, Homo sapiens
cagcggaacaagcaagctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323465 - DNA, 803 bp, Homo sapiens
  misc_feature (21)..(21): n is a, c, g, or t
  misc_feature (26)..(26): n is a, c, g, or t
  misc_feature (35)..(35): n is a, c, g, or t
  misc_feature (719)..(719): n is a, c, g, or t
  misc_feature (742)..(742): n is a, c, g, or t
  misc_feature (769)..(769): n is a, c, g, or t
ttacgggcttaagtcgaggcngggtngaatcggcngaggccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaacaaaaaaaaaacaaaaaaaaaaaaaacggggggttttattgggggggggggaaaaaggggtttggaaggggcctgggcataggngttccgggccccgtttttttgtncaagggggaaaatgggggggcccccangggggggggaataatcagaggccggtctgcatcc

SEQ ID NO: 323466 - DNA, 917 bp, Homo sapiens
  misc_feature (18)..(20): n is a, c, g, or t
  misc_feature (691)..(691): n is a, c, g, or t
  misc_feature (695)..(695): n is a, c, g, or t
  misc_feature (699)..(699): n is a, c, g, or t
  misc_feature (702)..(702): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaaaaaaaaaaaaaaacaaaaaaaaaaaaaaaaaaaaaaaaaaaaatttgggggggctgggncctngaanagntttctgaaccctcggtgtggggcgccggcccgtagtttagtgaaccgtggcctggggtgccagaaagacccggccagaccaggtgctgcgttcccaccataaaaagccggcgaccaggttggacgactccaggggttcggccacggtctacacggtccgcgtgctatcccccgcgcgcgcgtgaagggcagaaaaaagaggagaacacaagcgct

SEQ ID NO: 323467 - DNA, 572 bp, Homo sapiens
cagcggaacaagcaagctcttcctgctctccatcatggcgccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323468 - DNA, 671 bp, Homo sapiens
  misc_feature (18)..(20): n is a, c, g, or t
  misc_feature (643)..(643): n is a, c, g, or t
  misc_feature (647)..(647): n is a, c, g, or t
  misc_feature (657)..(657): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaagtcgacgcggncgcnaatttagtantagtaggcggctgc

SEQ ID NO: 323469 - DNA, 699 bp, Homo sapiens
  misc_feature (18)..(20): n is a, c, g, or t
  misc_feature (634)..(634): n is a, c, g, or t
  misc_feature (636)..(636): n is a, c, g, or t
  misc_feature (644)..(644): n is a, c, g, or t
  misc_feature (648)..(648): n is a, c, g, or t
atccttaattaaattatnnncccccccccccgctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaacncnacgagccncgcnaagagcccacaaagagccacccgacgagccactctaagcgcccgcaacgag

SEQ ID NO: 323470 - DNA, 709 bp, Homo sapiens
  misc_feature (582)..(582): n is a, c, g, or t
  misc_feature (641)..(641): n is a, c, g, or t
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctgagcaaataaattccccggntttctttttttttttaaaaaaaaaaagggtttttttttttccccgcccaaaagagcaantaaaacacgggggtttttcttttttcccaaaagggggttgggaaaaacaaaaccaaaccaaaacatca

SEQ ID NO: 323471 - DNA, 2349 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagaattggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttatagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaagaaatgtgcaattctgttgtgtgttctgtgaaaggatcctggccatattcaagtccttggacctcaagccacttaaagcttcgatgggagtagctggtaacaaccccgtcatcctctgattggatgccagtatttcctggcagatccaagtccaagcttcatagcattcattgcctgtgcttgccacaccttggttgatgtgctgtggtgcagtagccccatttggaagggagggtttggttgatgttggggtttgaatttagagccttgattaagcagggtgcagtgctcctgtgttccaggaggccccctgctattcagtgattctgttctgtactagaaattttatcagcattgatgcgtcatgaaggaatgacaggctttggtgtgatggttgagattaaatttagacttaactgttcaggctcaggtttcttttacaatgagagtataaggttcttgggaggcagtatgtgcagataagagggcagtctttccgtttccagccctttcctttaactgttacctcgggtgagttgttaatctgcctcagtttccttatctgtatcaggaggcagtaatagtagtatctctcagaggattaaatgatttaatacttaacaaaatgctcagactagcaccagccacgtagtgctcaaaaggggtttcatttttgtgtttgggtataagaaatattacttctgctagcttgcttccctttggtgca

SEQ ID NO: 323472 - DNA, 1298 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323473 - DNA, 469 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctcgcctgctctattgtctggagcagttcacatccaaaagagccagcaagctcattggcca

SEQ ID NO: 323474 - DNA, 758 bp, Homo sapiens
tagctgggacctggatttgctttcctttatccgtcgccatccatggcaggccgagcctgcgggggctacttcgcccgcagcccgaggaatatggagcccgcaatgcctgctggcccaaaactagcagagccgttcgagccaaggacgcagggttgaattctgtcactttccctgccatcgttttaggagcggctccgggcacttgcccggagtgctcagaagcacgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaa

SEQ ID NO: 323475 - DNA, 362 bp, Homo sapiens
ggcctggtacaggccggaatccttaggatccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaagggtccggagtttagttatgaaccacctctagttctgacttggtttggtcggccaatgtcttgtt

SEQ ID NO: 323476 - DNA, 698 bp, Homo sapiens
tgtctagcattaaactcacacacattaatgtagtatttcaggctttctgcttactattctcttaaaaaatacatctacaaatatctaaaaatgtactcatctttgaagaaccagcctaatataaggcgatattctgtatgaattgtttcttgagatgtcttactttgaaagaggtgaaattctttcaaggtagagaaacactactgcagttagcaagccaccttagacatattctttgccacattcaatttaattttaactctctttgctttttttctttcctttatttaatatttactacaagttcattttatcctagatgggctagtttgcttatctattcatctttcatatatttaaacatatacacttctattaaattttttcttttattttaaaatttaaaattcatttttaaaatataaagattttttaaaatcatatgttactccatttatttattaattaaatttttagggttcttctgttttgtatgaaatacaagtgatttttaagcacagaatactctactaatcctttattgccttatagttttcatcaactctatgacagttctttccattacatggaatatgctatgtgtgcttaagtgtgtataatgtttacattgtctagtgtgaagtatgcttaagtgtatgcggataaatggtgtgtgtgtgtgtgtgtgtgtatgtaca

SEQ ID NO: 323477 - DNA, 750 bp, Homo sapiens
aaatatagcggtctgtaactgctatgatgatctataagtataagagacacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgtaaaaaaaaaaaaaaaaaaaaaaaaaaaaaaaaaaaaaaaaaaaaaaaaaaaaaaaaaaaaaaaaaaaaaaaaaaaaaaaaagaaaagaaaaaagaagcagcagagacaacaaaaaaaaaaaaaaaaagaaagaacaaagcagagaggaacgagagggggaggagggagagaagacagagagagaacaagagaaaaaacagagagggagagaggggaggaatgaagagaaggagaaaaagagaagggagaaggagaaggagagaagaggagacacgcacagcaaggaaggaggggggagtgaaagggcgcgagcaccggaggagaaaggaggagcaaggcagaggcgaagaagcacgagagggagagacaaacgaacgaagaaaaaaaagcacaagacacaaagcgagagacggagagagaggaggaggaggagcgtgggcgcagagaaacaagcggacgcacaacccattggaaaacgcacgcagcgggag

SEQ ID NO: 323478 - DNA, 2335 bp, Homo sapiens
acaaaggcggggattgcgtagggaaaggccctaggccataaacgggggtggggcctccccggaggccagtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgtaaaaaacaacaaaaaaaaacaacacaaacaaccacaacaacacaacaaacaaacaaccacaacaacaacaaacacaacagcaacaacacagaccacaccaaacaacaacacaacacaa

SEQ ID NO: 323479 - DNA, 2167 bp, Homo sapiens
aagctggtacggtcctcagtcgtatcatcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 323480 - DNA, 1293 bp, Homo sapiens
acgggaataagtaccattcgtttgctatccgctactagtatagtagcgactatgatcatactcggttacttaggcggtacccgtagtgtacgtagaatcagatgcttggaaactccccattaaaaggatgcccgatgctgggaggggaaactgtaactgctggtatcctgatggagctcaggagagttataaacttggttcgtcatgcatctggaagacacaggtatcgacgtccaatacagattgccgtctcaccagatccagctcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 323481 - DNA, 587 bp, Homo sapiens
tacatacttccggataggccgagaaagtgttgagggaagaaagttagatttacgccgatgaatatgatatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 323482 - DNA, 2218 bp, Homo sapiens
acaaaggcggggattgcgtagggaaaggccctaggccataaacgggggtggggcctccccggaggccagtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 323483 - DNA, 513 bp, Homo sapiens
acaaaggcggggattgcgtagggaaaggccctaggccataaacgggggtggggcctccccggaggccagtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaactt

SEQ ID NO: 323484 - DNA, 96 bp, Homo sapiens
cacacagcagctgaagccatcttttcaaaatgcaaattggatcatgtcacctccctcactgcagggcctgacattttaagggttttccgttgccct

SEQ ID NO: 323485 - DNA, 515 bp, Homo sapiens
  misc_feature (31)..(31): n is a, c, g, or t
cgttaccaatctgaagtgggagcggccgagnggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323486 - DNA, 524 bp, Homo sapiens
gcggccgcctactattactaaattcgcggccgcgtcgacctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323487 - DNA, 568 bp, Homo sapiens
gtgctccgtgcgcaagcgctttcggcggcgattaggtggtttccggttccgctatcttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323488 - DNA, 765 bp, Homo sapiens
aggtggttggtagatactaagtgatgttcgtggtttggggtcaaggcaagaagtggggtctggagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaaggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323489 - DNA, 680 bp, Homo sapiens
tgtttagactacaggccagggtgtgtgagaagcctagcagggccaggcttggaggagtgaaaggaagacaggtactggggcaggaccagttggacttggtgcaggcaaagggatagcaactgtggtgtaggcacctgagcttgtgctactcaggcatgcattgctcaccagtctatcctgcctcccttcctcctgcagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323490 - DNA, 1028 bp, Homo sapiens
  misc_feature (817)..(817): n is a, c, g, or t
tgatgaggatccccgaaactctggcggacgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaaaaagggggggggcggaaaaattttccccggggggggcccaaatttacgggacacccgttttttttgaacagaggcgggcccaaggagggcgctaaaataggccagagcggggccgcggctaacaccagcgccctgaggaacacctggacctggggatttgggagaagagccctcctgcggggggggctatgtgggaccaccccaagagagattaacggccaaggaatatcccntacagtgtaggtgtaccccaccggcttctcgccgagcagttgtgcagggattgattaagattacgagggcacgaatacataagtgcatctacgaatagcgatctatcatgatacggcaacagtcaccatgccacagcagctggtaaagctcaaccaagtaacactcaagagctactcacaaccacaaccagtaagtgataggatatcgaaa

SEQ ID NO: 323491 - DNA, 1260 bp, Homo sapiens
  misc_feature (964)..(964): n is a, c, g, or t
aggtggttggtagatactaagtgatgttcgtggtttggggtcaaggcaagaagtggggtctggagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaaggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaacgggggcctcattggcggggggggggaaaaagaggggttggaagggggcggggaaaaaggggtccgggccccagttttttggcccaggggggaaaacgggcgggctccccaagggggggggataaaattgcaaaacgccgcggctagcctgctaggacggtggtggcaaaaaacngggggtgacagcacccgggacaatcccaggccactgagtacccattgtgtaacacaaaacgtggcgtgaacacaacacttgaaggggcatggctataccaagtttccctaccggagatcacgtgacagcctcgatacaaaccaaccgaggttccgggacgaggacagggacaagtaggtgtaacaaaagggcgtgatgacacacacacaaggagcagggggacaacaacaatagctacacacagggacagcatggcgggacacagaataacagcaagtcccagatccgcgcagagc

SEQ ID NO: 323492 - DNA, 813 bp, Homo sapiens
tgtttagactacaggccagggtgtgtgagaagcctagcagggccaggcttggaggagtgaaaggaagacaggtactggggcaggaccagttggacttggtgcaggcaaagggatagcaactgtggtgtaggcacctgagcttgtgctactcaggcatgcattgctcaccagtctatcctgcctcccttcctcctgcagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcacaaaaaaaaaaaaaaaaagggcggccgaaatatttgaaaaaagaaattgcattggtactgaacacgtacagacctttttttcttgccattaataccaaatacaatataaatgctatgtaaatatgctacacca

SEQ ID NO: 323493 - DNA, 377 bp, Homo sapiens
  misc_feature (22)..(22): n is a, c, g, or t
  misc_feature (31)..(31): n is a, c, g, or t
gagagagatctagaggatcccnacgaggcgnggcgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagctatgctcgccttcaccctcgtgccgggtaccgag

SEQ ID NO: 323494 - DNA, 268 bp, Homo sapiens
cgcggccgcgcgacaagacgacagaagtgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323495 - DNA, 222 bp, Homo sapiens
aggacacaaaaacaaaaacaatatgcgcctagcgctcgaggcctggtgtaattggcagagcctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323496 - DNA, 329 bp, Homo sapiens
aggtggttggtagatactaagtgatgttcgtggtttggggtcaaggcaagaagtggggtctggagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaagggtacttattccatcaggagatactgacgagtccttccgccgctaaa

SEQ ID NO: 323497 - DNA, 170 bp, Homo sapiens
gcgtcgaccttcttcttgggacgcaggttgttggtgtgaccacacttcttcttgcggcagttgacagcacgagggtcaaataaggttgttctttccttgaagggcagcctcctgcccaggccccgtggccctggagcctcaataaagtgtccctttcattgactggagca

SEQ ID NO: 323498 - DNA, 637 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323499 - DNA, 842 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgta

SEQ ID NO: 323500 - DNA, 677 bp, Homo sapiens
taaaaatacggaagtttattgtaggacactcagtgtgaataaatggaatggaaaggcctacacatcgagactcatccatgattgatatgaatttaaaaattacaagcaaagacattttattcatcatgatgctttcttttgtttcttcttttcgttttcttctttgtctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323501 - DNA, 1288 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323502 - DNA, 590 bp, Homo sapiens
gactctacaggatcttcgtacttgtgacgccttggacgcctgatcttgacgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323503 - DNA, 590 bp, Homo sapiens
gtgctccgtgcgcaagcgctttcggcggcgattaggtggtttccggttccgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323504 - DNA, 2875 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323505 - DNA, 860 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagagggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323506 - DNA, 539 bp, Homo sapiens
tgatgaggatccccgaaactctggcggacgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323507 - DNA, 518 bp, Homo sapiens
  misc_feature (4)..(4): n is a, c, g, or t
  misc_feature (22)..(22): n is a, c, g, or t
  misc_feature (34)..(34): n is a, c, g, or t
ggcntgcatggaatttggacgngggcggtcgtgnggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323508 - DNA, 536 bp, Homo sapiens
tagccggtacctaacttttatttctttttttttcttcagcgaggcggcgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323509 - DNA, 952 bp, Homo sapiens
gactctacaggatcttcgtacttgtgacgccttggacgcctgatcttgacgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaacgcgggggacatggggggggggaaaaaggggaaaagggggccagtgggccaaggatggttccgaacaaccgatttttgtgtcaacacgggaacatcgcgccggcccccataagggcgggcaataactggcaagaccggggtacgcgttataatgcgaaatgtaatcacataacaagacgacgacgacgaggctcacctctgaacacaacgtcacaaacatccgacatagaactcggacagaacagcagcaaaaacagtgcagaggataatagagagaaaagaaagacgaaaaagacaacagcaccagcaacctgaac

SEQ ID NO: 323510 - DNA, 1026 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaaaaaaaaaaaaaaaaaaaaaaaaaaaaacgcgggggacatggggggggggaaaaaggggaaaagggggccagtgggccaaggatggttccgaacaaccgatttttgtgtcaacacgggaacatcgcgccggcccccataagggcgggcaataactggcaagaccggggtacgcgttataatgcgaaatgtaatcacataacaagacgacgacgacgaggctcacctctgaacacaacgtcacaaacatccgacatagaactcggacagaacagcagcaaaaacagtgcagaggataatagagagaaaagaaagacgaaaaagacaacagcaccagcaacctgaac

SEQ ID NO: 323511 - DNA, 747 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcatacctcgaggtatgcctgcaccaggaagcctgagactgagaaatgcttctgggattcttctgagcttggaaaattagtatgaggcaccgaaatcatctcaatgaaactga

SEQ ID NO: 323512 - DNA, 1001 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaacaaaacaaaacaaaaaaaaaaaaaaaaaaaaaaaaaaaaacgcgggggacatggggggggggaaaaaggggaaaagggggccagtgggccaaggatggttccgaacaaccgatttttgtgtcaacacgggaacatcgcgccggcccccataagggcgggcaataactggcaagaccggggtacgcgttataatgcgaaatgtaatcacataacaagacgacgacgacgaggctcacctctgaacacaacgtcacaaacatccgacatagaactcggacagaacagcagcaaaaacagtgcagaggataatagagagaaaagaaagacgaaaaagacaacagcaccagcaacctgaac

SEQ ID NO: 323513 - DNA, 1677 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaaaaaaaaaaaaaaaaaaaaaaaaaaaaacgcgggggacatggggggggggaaaaaggggaaaagggggccagtgggccaaggatggttccgaacaaccgatttttgtgtcaacacgggaacatcgcgccggcccccataagggcgggcaataactggcaagaccggggtacgcgttataatgcgaaatgtaatcacataacaagacgacgacgacgaggctcacctctgaacacaacgtcacaaacatccgacatagaactcggacagaacagcagcaaaaacagtgcagaggataatagagagaaaagaaagacgaaaaagacaacagcaccagcaacctgaac

SEQ ID NO: 323514 - DNA, 3002 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggaggaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323515 - DNA, 1415 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggaggaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323516 - DNA, 1986 bp, Homo sapiens
tgtcaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323517 - DNA, 867 bp, Homo sapiens
gtgctccgtgcgcaagcgctttcggcggcgattaggtggtttccggttccgctatcttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaagacatgccaacaaacaaagcaagaacacacaaacaagagcacagacaggagcccgaacaccaaaggccgaagtgacagaaacactcgcgggccgaatgcaagccgcaagccgcgaaaccgggaggccccagtaaccgcggagggaaacccctttcgaagtggcattcaaaggacggcgaactgacaacacgtgaccacagtaccgacaagccgcacacggaacacagaaattagaaccacaaacacgagcccgaacgccgtaacacacggggagggtaccacacgcccggc

SEQ ID NO: 323518 - DNA, 2959 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323519 - DNA, 1242 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaaaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323520 - DNA, 1997 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngcttagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323521 - DNA, 2195 bp, Homo sapiens
gcggccgcctactattactaaattcgcggccgcgtcgacctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323522 - DNA, 740 bp, Homo sapiens
gaaaaaaaaaaaaaagcaaagaaaacagaaaagaaacattggcatggatcgaggcgtgggtgggcggcgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaaaaacaagaacacagaaaacagacaacaccccgcgacacacttagcagacgcgccccacacgacacaaaaccagggcgatcgcacaacgcaaccacacacgaatataaaacaaggcgcaaccgcggccaccaaagggaga

SEQ ID NO: 323523 - DNA, 900 bp, Homo sapiens
  misc_feature (4)..(4): n is a, c, g, or t
  misc_feature (22)..(22): n is a, c, g, or t
  misc_feature (34)..(34): n is a, c, g, or t
ggcntgcatggaatttggacgngggcggtcgtgnggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattcaataaacagctgctgctcactctcctggt

SEQ ID NO: 323524 - DNA, 2224 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323525 - DNA, 1185 bp, Homo sapiens
  misc_feature (16)..(16): n is a, c, g, or t
  misc_feature (118)..(118): n is a, c, g, or t
  misc_feature (121)..(122): n is a, c, g, or t
  misc_feature (1128)..(1128): n is a, c, g, or t
  misc_feature (1182)..(1182): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattaccaaaccaaaaaaactggccattgccctgnaacccagtttcctcaatttttttttccccccccccccccccccccccccccccnttt

SEQ ID NO: 323526 - DNA, 2177 bp, Homo sapiens
gtgctccgtgcgcaagcgctttcggcggcgattaggtggtttccggttccgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323527 - DNA, 795 bp, Homo sapiens
gtgctccgtgcgcaagcgctttcggcggcgattaggtggtttccggttccgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgta

SEQ ID NO: 323528 - DNA, 978 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaacgcgggggacatggggggggggaaaaaggggaaaagggggccagtgggccaaggatggttccgaacaaccgatttttgtgtcaacacgggaacatcgcgccggcccccataagggcgggcaataactggcaagaccggggtacgcgttataatgcgaaatgtaatcacataacaagacgacgacgacgaggctcacctctgaacacaacgtcacaaacatccgacatagaactcggacagaacagcagcaaaaacagtgcagaggataatagagagaaaagaaagacgaaaaagacaacagcaccagcaacctgaac

SEQ ID NO: 323529 - DNA, 867 bp, Homo sapiens
  misc_feature (16)..(16): n is a, c, g, or t
  misc_feature (118)..(118): n is a, c, g, or t
  misc_feature (121)..(122): n is a, c, g, or t
  misc_feature (688)..(688): n is a, c, g, or t
  misc_feature (694)..(696): n is a, c, g, or t
  misc_feature (699)..(700): n is a, c, g, or t
  misc_feature (711)..(711): n is a, c, g, or t
  misc_feature (720)..(721): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaaaaaccngggggnnnttnnggggggggggnaaaaagggnnaaaaaggggaaaaggggacaagagagcaccgagacacacacatatattggaaaaaagaggggacaaaaaggcggggaccccacaaaagaggagcggaaaaaaaatcgagaaaacacggggaccggttataaacaagacaaaaaagt

SEQ ID NO: 323530 - DNA, 702 bp, Homo sapiens
  misc_feature (16)..(16): n is a, c, g, or t
  misc_feature (118)..(118): n is a, c, g, or t
  misc_feature (121)..(122): n is a, c, g, or t
gatccccctgaccttnggacgccctcactattaatctactgggagaactctctgtgctagtaaccacgttctcctgatcaaatatcactctctcagactacaacatccagaaaggtcnacnngctttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcacacaagaacaaaaacaaaaaaacacaacgtccgcaggccgcgaatttagtagtagtaggggcagc

SEQ ID NO: 323531 - DNA, 743 bp, Homo sapiens
  misc_feature (616)..(616): n is a, c, g, or t
  misc_feature (631)..(631): n is a, c, g, or t
  misc_feature (647)..(647): n is a, c, g, or t
  misc_feature (655)..(655): n is a, c, g, or t
  misc_feature (675)..(676): n is a, c, g, or t
  misc_feature (681)..(681): n is a, c, g, or t
  misc_feature (684)..(684): n is a, c, g, or t
  misc_feature (715)..(715): n is a, c, g, or t
  misc_feature (718)..(718): n is a, c, g, or t
gtgctccgtgcgcaagcgctttcggcggcgattaggtggtttccggttccgctatcttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaactcgggggggggcccggtacccantttggcctattagtngagtcgtattacaatnaacttggnccgtcggttttacaaacggnnggtgnctngggaaaaaccccttgggggtttaccccaacnttnatttggctttgaaggaaaattcccc

SEQ ID NO: 323532 - DNA, 1670 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattcaataaacagctgctgctcactctcctggt

SEQ ID NO: 323533 - DNA, 769 bp, Homo sapiens
  misc_feature (590)..(590): n is a, c, g, or t
  misc_feature (596)..(598): n is a, c, g, or t
  misc_feature (601)..(602): n is a, c, g, or t
  misc_feature (613)..(613): n is a, c, g, or t
  misc_feature (622)..(623): n is a, c, g, or t
tgatgaggatccccgaaactctggcggacgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcaaaaaaaaaaaaaaaaaaaaaaaaaaaaaaaaaaaaaaaaaaaaaaaaaccngggggnnnttnnggggggggggnaaaaagggnnaaaaaggggaaaaggggacaagagagcaccgagacacacacatatattggaaaaaagaggggacaaaaaggcggggaccccacaaaagaggagcggaaaaaaaatcgagaaaacacggggaccggttataaacaagacaaaaaagt

SEQ ID NO: 323534 - DNA, 2123 bp, Homo sapiens
gactctacaggatcttcgtacttgtgacgccttggacgcctgatcttgacgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttggagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccacca

SEQ ID NO: 323535 - DNA, 1260 bp, Homo sapiens
gactctacaggatcttcgtacttgtgacgccttggacgcctgatcttgacgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattataaatacaactgcgacaagatgatctgccgcaagtgctatgctcgccttcaccctcgtgctgtcaactgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattgactggagca

SEQ ID NO: 323536 - DNA, 314 bp, Homo sapiens
  misc_feature (204)..(204): n is a, c, g, or t
  misc_feature (270)..(270): n is a, c, g, or t
gactctacaggatcttcgtacttgtgacgccttggacgcctgatcttgacgctatcttctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaatgcgganagctctaagattggatttctgttgcgtttcctccatgttggagggtgtcggaatagagtctgagangcagaaggaggtctgggagtcatgcaggaatgaatacttctggt

SEQ ID NO: 323537 - DNA, 147 bp, Homo sapiens
tcagaacgcttacattcacctacagctgggcaaaatcacctaacacaaaaccaatttaataatgaagagttgaggccatgtgtggtagctcaagccagtaatcccagcactttgtgagacccaggtaggcagttcacttgaggccag

SEQ ID NO: 323538 - DNA, 1107 bp, Homo sapiens
tgctgtgttgcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaaggtaggtaaaggcattgtctttctgaccattgtgaaagaacaatgaaatgctatgactcctactgcaggtttaagaagaaagtgaagatggtgaaggtgctcatagacccttttggtgttaccaggttcctcaaatgggacattctatatggggcattctacatgtattggtttagttccattacttacaattaactggattaattttgactcttttttttttttcctgaacaaagagaaaggtgaaaagttctgtgatatattgggtccttgtcatcttgggataacctctttgttaggctcattttaaattaaacaagcatttttgaagagaataatgaactcagcgcatttatcatggaaaacatttctatggtatttgagctatttaatttactgagtgaaacttctttaaggtgggatgctctgttatgacaaaagtttgttcatgaagaaacagtatttattactaatgtgtagatgggagtgacactctgggagatgagatggtcataaaattgtcaggcttattataactaca

SEQ ID NO: 323539 - DNA, 653 bp, Homo sapiens
aggtctgttgagctgaggctgaaggatgagaaaggccaggaaggacttacttgggaaaatgtttgtggtgatatgtatgagtgctgcaggtgaaacaaaaaggaagccagtgtagttggatcagcaccaaataactccccaggcacatgactatctgctaagaactgcgttcgagataattcagcttgaacctgtgcctcctactcttgcaccatatctcaaccttgggacccacttctgcctgcacggaagacttaaagttcacttgcaatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattgaaaatgtatgaaaggcctggtcttgttggacagattgggctaattgatttaattggacaactgttcacacctgctaggtggaaagcataccacagacatctttcattagcactgtagctgcactgtctagaagataatctgagagtgcttgttgaatgaaggaata

SEQ ID NO: 323540 - DNA, 3402 bp, Homo sapiens
tgctgtgttgcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323541 - DNA, 892 bp, Homo sapiens
gattctcttaatttccaccgctacagatgtacatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323542 - DNA, 1042 bp, Homo sapiens
gtggtggttggtcgaaatttattaagccattaatgtgttcggtcgttgtttatgttctgggaccaagaagagcgaagacagtctggagaaaaaaattaagttggaagacatatactaccaagtattgagattcttaacctctagcttgtagaaagaaaaaccttccagaaagagctctctctatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323543 - DNA, 914 bp, Homo sapiens
  misc_feature (33)..(33): n is a, c, g, or t
caggggtttcaggggggaagtgtagcatgaaanggggggtcttattaggacgccatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323544 - DNA, 973 bp, Homo sapiens
  misc_feature (53)..(53): n is a, c, g, or t
aacatataagcaacttccaacaataaacacccccgcaaacaaagttaagagtnaccccatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323545 - DNA, 1097 bp, Homo sapiens
gtggtggttggtcgaaatttattaagccattaatgtgttcggtcgttgtttatgttctgggaccaagaagagcgaagacagtctggagaaaaaaattaagttggaagacatatactaccaagtattgagattcttaacctctagcttgtagaaagaaaaaccttccagaaagagctctctctatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323546 - DNA, 971 bp, Homo sapiens
  misc_feature (32)..(34): n is a, c, g, or t
gggggtggtacgacccctataaacagaaaggnnngctatagtcacccagaatactcatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacagtaagtcatctgtagagtttccgatggtcaagagcgggagcacttcctaatagatcttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323547 - DNA, 453 bp, Homo sapiens
aaaataattgtgctgtttatgaggagaaaaattttcccccgggccaaaatttttcaatagggggggggtaaaaaacccctttttaaacataaaacccaaagggggggcagaaaaaaagttttttttttcgggcgcgttaaccccttccaaaaggaaactttgtttgggtccggaaaaaaaggggggaaaaaaaaaaaggggggaaggaattgggggatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323548 - DNA, 3347 bp, Homo sapiens
tgctgtgttgcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323549 - DNA, 3418 bp, Homo sapiens
tgctgtgttgcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggttgccgaagagggatccagatgtctctaccctggccaactctttttactccttcattttccagtagttgggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccattaaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323550 - DNA, 927 bp, Homo sapiens
gttgttttgtatatggttagggataggagggggggggggggtcttcagagtgacgccagacacattcatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaagggtcgcaggcgaccagatctttctatccacatttcctatcaatacctccacaattatcta

SEQ ID NO: 323551 - DNA, 1059 bp, Homo sapiens
tgctgtgttgcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggttatccatccctgtttgggattcagggctgccttcatgaatgttttgctatactatgtcaagttgtttaccaatttctgcttctaatgcagctgtcagatgctcaaactgtctattagtcgaagaggctctctactgaccacctttctcaagtttcttcttcttacatacaatgtttttgacaagactaagcatatcaaaccatcttttaacaattgtaaagcctaatattggccagcatacaattcaattcattaaacattgtagcactgaaa

SEQ ID NO: 323552 - DNA, 243 bp, Homo sapiens
gtttttttggtcttatacagaattttccattctttcttttatggcttctggatttcgagtcacagaaagcatttccaccaaccccttccacacatacacgcacaagaattgacccatattttcttgcagaatttctatgctattactttttttacatttaaatatttgctccatttgaggtttatcctgatattctgttaagtatggattcaagttttttgtttttgtttttgtttttgtttt

SEQ ID NO: 323553 - DNA, 302 bp, Homo sapiens
atgcattaggggtagatgaatggatggatggatgatggatggaatcatttattctcaggatataaagatgacaatgctgattcacttccatagggtaggtgttttgcattctctctttttttgaaacagagtcttactctgttacccaggctggagtacaatggtgcaaactcagctcactgcagcctccacctcctgagttcaagcaattctcctgcctcagcctcctgagtaactgggactacaggtgtgcaccaccatgcctggctaatttttgtattttttagtagagtcagggtttc

SEQ ID NO: 323554 - DNA, 893 bp, Homo sapiens
catgctgaaagcagggcgggaccggggcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaa

SEQ ID NO: 323555 - DNA, 1305 bp, Homo sapiens
taatgatcctgtttagtatttttctttgtattttctttcaaacctacatctagaataagttgataaatcttttagaggttataatgtttctattttatatttaaagttggagatatatatatatctatatctatctatatatatatatatatacacacacatatatatatcattaaaataccctaagaatgtaacatagaaaataattttacattaaggaataatcagtgttcatttttaaaaagaaaaattataccatatacgaaacctgtattctgtacaggaatttgaattacactgtgataaaaagaggaagccaaggaagtcaacttgtaatgttcttatcttgttttccctaagatagattgaaagacaaagggaattcacttttccttggtgtcttatttaagatgctgattgtttgggtcacttcattatgttgacaaattccttatttgatatttagtatttggagttaggggaaatgagtatttcttttttcttttttacataactacaactgctgtgtttaagtaaagataccagattcaggttggctgaattctagttctagtttttctctaattcaaactcagtgttgcttgtcttcagtcttcctgttaaagtgaggtggaactggatggtgtatgatgacctcatgtagcctgaacatcctaagaaagttaaaatgtaagcattgctcctgtcagtggttatttgttcgttatattgcctcatgttaaaatacgtttttgtttattgttttaaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaa

SEQ ID NO: 323556 - DNA, 689 bp, Homo sapiens
gcggccgcctactactactaaattcgcggccgcgtcgacagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaa

SEQ ID NO: 323557 - DNA, 839 bp, Homo sapiens
catgctgaaagcagggcgggaccggggcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaa

SEQ ID NO: 323558 - DNA, 979 bp, Homo sapiens
catgctgaaagcagggcgggaccggggcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaaggtcttcagtcttcctgttaaagtgaggtggaactggatggtgtatgatgacctcatgtagcctgaacatcctaagaaagttaaaataacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaa

SEQ ID NO: 323559 - DNA, 93 bp, Homo sapiens
catgagagaaaacttgactcacttagctagttcattttcagaggtgtgtgttactgattaatgtagcactctctcttgctccacctacacagc

SEQ ID NO: 323560 - DNA, 1376 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323561 - DNA, 2185 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaaaaaaaaaaaaaaaaaaaaaaaaaaaaaaaaaaaaaaaacaaaaaaaaaaaacaaaaaaaagaaaacgaccagaaacgacggagcaacaaacaggacgaccgacgagggcggggagcggcccacatcggggagcgaggccggaggcgcgcaccgagccaggcacgggccgtgcaaggagagcggcgacggacgagcacgaccgcagcctcggagcgacgtgggtcgagcgcggcagagaacgcgcgagggcgcggcccctcccgccggccgaacgagcactccgcacagaggggccgaaagacgaggcgggggccgacatgggacggacgaagggggagaagacggaggagagggagaagccagagagagggcgcacagggaggacggagagcggagggagggagcggaagagacagggagagggagggcacggagggagagcggagagggacgagcgtaacaggaacgaacgagcggagaagcacaagagggaagctaggcggcagagtgccagggaggcaacaacaggaggagggagaccgaggagggagcgggacaaggaggcagcgggagcggaaggagcgagacgggcgcgaagaggggccgaaagggcatcgaaggggaagcgcgaagaggagcgacgcagcagggaagagagggaggagaagaaggaggcaccgaaccgaacgagacgacaaccgcgaagcagaaagagaggccggagaggccgggcggagaggaggggagagacagtgtcgaggcggcggcgggaaggagaccgaagtgacagggcaggaggacgagacagg

SEQ ID NO: 323562 - DNA, 1233 bp, Homo sapiens
cccctcgtctccacagcgcttcctcgcgagcggacgctggtagtgcgcgtcatgtcgtcggctcgtgtctgtgatatttgtgcccgcgcgtttggcgcccgttcggctctagagttcttcctgtcttgatcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323563 - DNA, 1347 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323564 - DNA, 991 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatctctttgtcattttgttgacatgcattcctccttttgtcatcttgttggggggaggggattaaccaaaggccaccctgactttgtttttgtggacacacaataaaagccccgtttatttgtaa

SEQ ID NO: 323565 - DNA, 1271 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtagacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323566 - DNA, 1590 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323567 - DNA, 965 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctctttgtcattttgttgacatgcattcctccttttgtcatcttgttggggggaggggattaaccaaaggccaccctgactttgtttttgtggacacacaataaaagccccgtttatttgtaa

SEQ ID NO: 323568 - DNA, 910 bp, Homo sapiens
taggctaggtacgaggcctggtggtgaatcggccgacgcagatatttgatcttccagaagaggacgctttactctacagagcaggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323569 - DNA, 850 bp, Homo sapiens
  misc_feature (33)..(33): n is a, c, g, or t
cgtttttgcttggggggcgctgggctagccaangtgagtgcttgctccccctgccttgtcccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323570 - DNA, 1195 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagcgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323571 - DNA, 880 bp, Homo sapiens
ggcatgagcacaagtggcaaggccccatggataaagggctgaacacccagagccattcaggagggtgtgggttcctggcctctaaccaaaggtcagaggggactggctggggaagtttggactgagggacatgacagggccatggtggccctgccagccagtcccctcgccctgactctcttctgcaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323572 - DNA, 924 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtagctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323573 - DNA, 337 bp, Homo sapiens
ccgcgcgggccccgccccctccatcactagccaatccccgtgcttgtgacatatgggcttgcggccccgcccgctcccatcgcgagaccggttcccaccgccctgactcccgggcgggccccgccctctccgccgctagccaatcctcgcgttgatgacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgc

SEQ ID NO: 323574 - DNA, 787 bp, Homo sapiens
ggtaggcccgggccgccgccaggcctccgcctgagcccgcacccgccatggacaactacgcagatctttcggataccgagctgaccaccttgctgcgccggtacaacatcccgcacgggcctgtagtagggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgcccc

SEQ ID NO: 323575 - DNA, 1189 bp, Homo sapiens
  misc_feature (1038)..(1038): n is a, c, g, or t
  misc_feature (1060)..(1060): n is a, c, g, or t
  misc_feature (1065)..(1065): n is a, c, g, or t
  misc_feature (1068)..(1068): n is a, c, g, or t
  misc_feature (1070)..(1070): n is a, c, g, or t
  misc_feature (1075)..(1075): n is a, c, g, or t
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggtgagaggaccnttaaagggccagagggctgggncaacnagntnggganccggtcagctccacagggggcgggccgcgcggcctttttgtggggcggcacccaaagttcccgttctccgggggaacccgccttttggcctttgggggaaaccctttcgcttca

SEQ ID NO: 323576 - DNA, 1270 bp, Homo sapiens
aaaaaaaacaaaaaaaaacaaaaacatattactacgtacgagacctggtgtttacgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323577 - DNA, 1500 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtagggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323578 - DNA, 1196 bp, Homo sapiens
  misc_feature (158)..(158): n is a, c, g, or t
  misc_feature (222)..(222): n is a, c, g, or t
atagcgctggtgtatgtagagcgcgtccgatgcgctcgtgccgcccccgccgtgtctcggagcgtgtcgcgttgtagccggcgcgcaggcctccgcctgagcccgcaccgccagacataccgttttcggatagatgacacttgctggcgccggtacanacatcccgcacgggcctgtagtagatatcgtagtacgagaagaagatcttcagaaagattaccnagagaacccaaagaaaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323579 - DNA, 1523 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323580 - DNA, 1455 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggataggtgcgtagtgggggagcccagggacgggctggttctgggtccaggctcctggcccacttgctcccctcttttgcctcagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323581 - DNA, 1669 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggataggtgcgtagtgggggagcccagggacgggctggttctgggtccaggctcctggcccacttgctcccctcttttgcctcagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323582 - DNA, 1564 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggataggtgcgtagtgggggagcccagggacgggctggttctgggtccaggctcctggcccacttgctcccctcttttgcctcagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 323583 - DNA, 993 bp, Homo sapiens
gtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgagctggctggcaggcgtcctgtacttgggtacaacctaggggatcgcggctgtgtttggataaatccaggggggcactgggtacaaatggtg

SEQ ID NO: 323584 - DNA, 389 bp, Homo sapiens
gcatccattctctaatgcttacccagtatcaggcactaatctagacactggagatacagcaatcattaaacaaaatccccaacctcagataatttaaattgtagtaggccaagacagactaggtgggaagggagaagaaaatagacagtgagctgcccatacagtgaattagtcaatgccacaggtctacatgagtcagactattctgactgttgctttgcttctgctgtctgttatgataaccatgtccaccttgcctttgtcaaatgagtcccttcacttggcctctgctaccctggaatccagttattcccattgcatttaaatttttcaattgagtgactgcagtttccattttaaggtccggcctacagagaagggcaatcatg

SEQ ID NO: 323585 - DNA, 981 bp, Homo sapiens
tttttcctggatcaggtttcacctccacagtggtccggtctgtgtcactctcaccctttgcatcggtcactttcaggtgaaaagtgtaggttccctcaaccaggtttgaaagaaaaaggatagggtgatggtcagagtgatttaacacctcccctgctgctgggctcccctcatctcgagtccagaggtagctgactattcccttgtcatctgaggacttagagccatccagctctgctgtgctcgtgggtagggtaatcaccacattcccagttatcttggctataggtggtttgtttatttcttctttgacaatgacattcacagagctctggctttgcaggttcctctcatctttgacagtcaaggtgaacacataggtccccacttgcagcccagtcacagtagcaacactgctgttagcattctcgagctgcaccccatcaggtccctgtgttttttcccagagatatgagataattttctgatcatctgagctcttgctgccatccagggttgtgctatccacaggaagggtcagctctttatctgggcctgcatctgcctgaggaggcttattgttttcaggttgcacaataacagtcacttgagcagtggcctgctgtcctattgtgtcagtcactgtgagctggtaagtgtagtctccttcttgcatcgcagagagctgtaaggttggtgttctaacaccctgcatctccaccactttccctttgctgcttgggctgagtgaccactcatagctggtgatgccatgatcatcagtgctctggttcccaaagagggtgatggagttttggggcagggtgatcacttggttggggcctgcgttggccacaggggggtaatccacagctttgttcactgtcaggtttgcagtagtagagttggtagctccatcagagtctactacagtcaagctgaagtgtcctcggccgattcacacccagctccactagcctt

SEQ ID NO: 323586 - DNA, 531 bp, Homo sapiens
gccattctggggtcttgagagcagtggtcctcttgtcacagctccactaggcagtaccccagcagggactctgtgtgggggctccaacctcacatttgccttccgcactgctggagcagaagttttcatgagggcactgcccctgcgtttccatacatcctctgaaatctaggtggaggttcttgacttctgtgtacttgcaggctcaacaccacatggaaactgccaagacttgaggcttgcaccctctgaagccacagcctgagctctacattggcccttttcagccatggcttgagcagctgggatgcagggcaccaagtccctaggctgcacacagcactgagaacctgggcctggcccacgaaaccatttttccctcctaggcctccaggcctgcgttggccacaggggggtaatccacagctttgttcactgtcaggtttgcagtagtagagttggtagctccatcagagtctactacagtcaagctgaaagtgtagtacccagaaccgggatgcgatcctctag

SEQ ID NO: 323587 - DNA, 4010 bp, Homo sapiens
aggaggcggtgtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctact

SEQ ID NO: 323588 - DNA, 3920 bp, Homo sapiens
ttgaggtggattaaaccaaacccagctacgcaaaatcttagcatactcctcaattacccggggaggggggatcatgaggtcaggagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctact

SEQ ID NO: 323589 - DNA, 3486 bp, Homo sapiens
aggaggcggtgtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctact

SEQ ID NO: 323590 - DNA, 2220 bp, Homo sapiens
agcggggtgttgtgtcagagagggttgtttccttgaagggggaaacccttagcaaggtgcctcatgatatctgactccatattcactcacatgctgaactgggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctact

SEQ ID NO: 323591 - DNA, 216 bp, Homo sapiens
aatcaaaggcccctaaagctttctcagtttgtttggaggtttctaaaaatgcagtccagcagctctacttctcttgggcaagaaaaaataggaaccattccctcctacctgcatctccaccactttccctttgctgcttgggctgagtgaccactcatagctggtgatgccatgatcatcagtgctctggttcccaaagagggtgatggagttttg

SEQ ID NO: 323592 - DNA, 405 bp, Homo sapiens
  misc_feature (109)..(109): n is a, c, g, or t
cccactgataagccattaagagcaactcaactcataatagcaaataaaaccttgctcttccaaaggtctggaggctttgcaaaaaataaggattttgtgtcaatacatnacctgtgttttttcccagagatatgagataattttctgatcatctgagctcttgctgccatccagggttgtgctatccacaggaagggtcagctctttatctgggcctgcatctgcctgaggaggcttattgttttctggaagacaaagagttagaggtcaaaagcagccagtccaggtgggaaaggagaggaaccaattgggacacatgttctggaagccatggactctgcctctcaggccacagaactgtcagatactgtgggagatgtggttaccgtcagggagcacacaata

SEQ ID NO: 323593 - DNA, 3943 bp, Homo sapiens
taaatgcagctagattcaaatgggctgataaccaaattttaacacatcagcaatttgcattcagaaatttaaaaaatactgggccagacataaccctcaggttactttacctctgagggtgcaacctcttctcctcaaaatgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctact

SEQ ID NO: 323594 - DNA, 5635 bp, Homo sapiens
taaatgcagctagattcaaatgggctgataaccaaattttaacacatcagcaatttgcattcagaaatttaaaaaatactgggccagacataaccctcaggttactttacctctgagggtgcaacctcttctcctcaaaatgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggtaggggccctgggtgccagagcttctaggtctgtgcactctctctgtggaaggctgctgtcactagcccctcctgagtgtgtcactaacagcccactgtgcttgcaaagcattttgttcccttttgcctgatgaagactgagggtcagatttgccctgagctgcactggacaaaatgcctccaggacccacttcgcgtgctacttccgcttggcgggggtgctgggcctgttgttttcctttgcctgggcattctcctcatgtttcccacctggagttccgcttttccaactgccccaggtagtcagggtcagggaccttggacttgtctcttactgctgaccagtctgtgctttatgggcagagatgagacccaggcccgtgtctgccagctgaccacctttcagccagccttgttctcctgtcttcctatctttatcatttggcaagtcctcagcttctgtcagtgtcttagggcagataggagggcatttccttgcacaaacagtaagatgactttgagtgatggcactgggagatcagggcaggtagtaggccttccttcctccgctgggctgggtcacctggcgagggtttcactcatcatggatgccatgggacaggtatcattggtttatgagagctagactctataaagcgattcctaaacactctgcaagtagaactatttttatataaagcatttattaaacacttttcatgcttaaagctttgtgttagggagaggctatgggggtatagggagtcatcagacacaggctgtgctctcagtctagtgagggagaaaagacacacagtagcagaagagaacaggctcacagcagtctggactctgcaccaagcagctcgatccaccaacactgtcaaggtggagactggaggtggtggggcttgaaatgagcccaggaaaccagagcagtgagggcgggcggggcatttcacccaggaatattgagaatgagggcctggaggtgaaatgtgcaaaacccacccctcacactgcagccaaggtttttatcatgttactctgatcatgtttttcaccccctgacattcttcaatgacttactatttctagcacaaaaagctagaacttttggtctggtagatgtggcctttgtgagcttacatcagtttgcttttctggaatctttctctttgctgatctccctcttttctaaacaagttcttctggttcatccagtaatctctttcttttttaaaaatgtggcgacaaggtcttgctctgtcacccaggctggagtgcagtggtatagtcatagctcactgcaacctccagctcctgagctcaagtggtcctcctgcttcagcctcccaaagcagctgggactacaggcatgcaccaccatacccagccctagaaagctctttcttatccctcccttaacctcctcaagttgtgctcacctttctctcacatgcctgggtcggcatttctctcgctgtctcatgattagttatgtttgcctgtctccccacccatcagtgaaatccctgagggcaggggctgtctcattcatctgtggatatggagcgggaccactatgtgccaggccctgtgccagacactgcttatattgtggtgaatcaaacggacagacttcactcttgtgtagcttatgtcagacagacattaagcaaactcacaaatacataaaatatgctcataaaaggcctttatgaagaaaaacacttaagctgagacctggataagtgggagctagccagataaagctgcaggaaatagcattccaggcaaaggaacaaaactggtgcagacccagctgctagaaggagcagagagcatttgaggaggtagaagaaggtgacatgatggacaggttcaccttcccacagagtaaggggtgagtgacccaaggctcaatggatgagcagggtccctgctgaggacttctcttgagtacaatggggagccactgatagctttttaaggggatgaatggtgggatttggtttacatttattattatttgagacagagtctcactcttatcacccaggcaggagtgcagtggtgcgatcaaggcccactgcagtcttgacctcctgggctcaggtgatccttccacctcagcttcctaagtagctgggaccacaggcatgcgccaccatccccaggtttttttgttgttgttgttgttgttttgtatttttggtagagacggggtttcatcatgttgcctaggctgttcttgaactcctgggcttaagtgatctgcctgccttggtctcctaaagtgctgggattataggtgtgagccatggcacccggtcttggtttatattttaaaaagacaactgtgtagctgggcgtggtggtgggtgcctgtaatcccagctactcgagaggccaaggcaggagaattgctagaacctgggggtgtgaaggtttcagtgaactgagatcactccaacctgggcaataaagccagactctgtctc

SEQ ID NO: 323595 - DNA, 4152 bp, Homo sapiens
tttttcctggatcaggtttcacctccacagtggtccggtctgtgtcactctcaccctttgcatcggtcactttcaggtgaaaagtgtaggttccctcaaccaggtttgaaagaaaaaggatagggtgatggtcagagtgatttaacacctcccctgctgctgggctcccctcatctcgagtccagaggtagctgactattcccttgtcatctgaggacttagagccatccagctctgctgtgctcgtgggtagggtaatcaccacattcccagttatcttggctataggtggtttgtttatttcttctttgacaatgacattcacagagctctggctttgcaggttcctctcatctttgacagtcaaggtgaacacataggtccccacttgcagcccagtcacagtagcaacactgctgttagcattctcgagctgcaccccatcaggtccctgtgttttttcccagagatatgagataattttctgatcatctgagctcttgctgccatccagggttgtgctatccacaggaagggtcagctctttatctgggcctgcatctgcctgaggaggcttattgttttcaggttgcacaataacagtcacttgagcagtggcctgctgtcctattgtgtcagtcactgtgagctggtaagtgtagtctccttcttgcatcgcagagagctgtaaggttggtgttctaacaccctgcatctccaccactttccctttgctgcttgggctgagtgaccactcatagctggtgatgccatgatcatcagtgctctggttcccaaagagggtgatggagttttggggcagggtgatcacttggttggggcctgcgttggccacaggggggtaatccacagctttgttcactgtcaggtttgcagtagtagagttggtagctccatcagagtctactacagtcaagctgaaaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctact

SEQ ID NO: 323596 - DNA, 1820 bp, Homo sapiens
aggaggcggtgtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccaggctcaacaccacatggaaactgccaagacttgaggcttgcaccctctgaagccacagcctgagctctacattggcccttttcagccatggcttgagcagctgggatgcagggcaccaagtccctaggctgcacacagcactgagaacctgggcctggcccacgaaaccatttttccctcctaggcctccaggcctccagcccctgtgagggctgctatgaagccctctcacatgccctagagacattttccccattttcttggggattaactttcagctcctcattactaatgcagatttgtgaagccagcttgaatttctccttagaaaatgggattttgttttctattgcattgtcaggctgcaaattttctgaacttttat

SEQ ID NO: 323597 - DNA, 180 bp, Homo sapiens
taatgccaccacggatctgacagaaggtggagctcaggcggtaatgctcactcacctgctgctgacctcctgctgtgcggcccagttcctaacaggccatggactaggaattggagcccctgctttaggacacagtataagcaaataaatgcaaatataagtgactcttttttttttttt

SEQ ID NO: 323598 - DNA, 2686 bp, Homo sapiens
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323599 - DNA, 2272 bp, Homo sapiens
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggt

SEQ ID NO: 323600 - DNA, 3678 bp, Homo sapiens
gttcttggaagagttctgtgagttactatttataacatcttagagcaattagtggtgcaaaatccaccaatgtttgcccacattaacattaagtgccattatacctgtaagtgccttgactatggctgtagtttgatctcaggaggggaggttgataaatgctcttctgtcttcttaaaacagtgcctaaagatgattaatatgattaacatttgctattttccctcacctcccagggtaagataatcaggagcagaatgtgaagaactttcctctatataaagatcagcatttattcaggccgggtgtcgtggctcatgtttgtaatccagcactttagagggcagggtgggaggatcccctaaggccaggattttgccagcagcctgggctgcatactaggagtgagaccttgtctcaaggaataatgttttgttttgttttgttttcctgaagaaaagactactgagagccagtaagactgaaagaatggacatcttcatatcctgttagtttgagtgtgaatttgtacagttttcatacagagtggctctaggtataaaaacttttgagatgttaatagcttttgacctagtcattctactcttaaaagtatcttaaggaaataatctcaaatgtgagcagttttacgtgagggaggatattctttgtagcataatttatatgaagaattagaaacaccctaaggtccatcagctaggggaggacagcagaggggacggggaagcatcaggagggctcggcagccacagcaggggctgggccggcatctagcaggatccaggtctttgtgggacaaagaatcttagagaagcaacggggacacaggctgtccactgcagcaccagtgagttcaccaagacgaagagttgagcacagagtgtgagacagggatttgcaatgaggagtcatttaccatgagcgtgtatacatgactcaatattgtatatttaagggagtagagcacagtaattgaagacatgggattgaagcagaagtcctggctctagcactattgtgaaaacacccataagttccctaacttttgtggattcctctgtgttcaaatgggaaagtggtacccatctcctgtcctgtgtgtgatcatcgaatgagatacatgtcagaggccatgcacatcacagacacacaatacacactggctatcatcaactagttatcatacatgttcccaggcccaggtcattgtcagaatgttccctcccatctctattcctgtgtatagactctgtagtttctgtaatgatcagatggctgcccctcctctgattatcttcttctcatacccctacaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323601 - DNA, 2708 bp, Homo sapiens
gcctagggtgtcacagagtgaacaaagcaggaagaaggggaagggaagaccccctcccgtcaccccgtcccttacagcaagaagtgtccagatgcccctctgcatactcccctggtgaactgctgcccaggactgggtcccccttttagtcttgctgcgtaggggccccagaagacagatatctggatgcctcgaccctgaaacagaggtgggaagtggaaagagggaggcgagtggcttttgaggagggggcttttgtataagagctggaggatgcccgggaaccactgagctgttaaaataaagtctgcaaacaaagaccagctgctggaagtgggtgtgccggggagtgcgcagagacacaaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323602 - DNA, 1676 bp, Homo sapiens
tacactaacagcgcgcttggcttgatcttttggctacatgagtcgccatgtatgacaacttcattctcaaagagtagcaggtgtgtacagttttccaagcagcagtcacccaatgtcactcttcttcaagatgaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323603 - DNA, 1080 bp, Homo sapiens
  misc_feature (47)..(48): n is a, c, g, or t
cttagtgcggacacccgatcggcatagggcaatacagcccagaactnntggactcaagcattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323604 - DNA, 537 bp, Homo sapiens
agtggtacccatctcctgtcctgtgtgtgatcatcgaatgagatacatgtcagaggccatgcacatcacagacacacaatacacactggctatcatcaactagttatcatacatgttcccaggcccaggtcattgtcagaatgttccctcccatctctattcctgtgtatagactctgtagtttctgtaatgatcagatggctgcccctcctctgattatcttcttctcatacccctacaggacaagaggaccctgccttggtgtgagagtgagggaagaggaagctggaacgaggtgagtttctgtaaatactagctggcagggccccaggagataaacactctggacatttgctgctaccacagagggatctgcaaagacccagcccctccagcctccctctgtacacaggaggctcaccttcgatcccacaatttgttttctcgttctcaagggttaaggaaaaccttccagtctggacagtgactggagagctccaaggaaagcccctcggtaacccagccgctggcaccatg

SEQ ID NO: 323605 - DNA, 2545 bp, Homo sapiens
gtgctggggagcagcgtgtttactgtgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323606 - DNA, 2327 bp, Homo sapiens
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtaaaaaaaaagtcgagctgccgcgaatttagtactagtagtcgatccccggagact

SEQ ID NO: 323607 - DNA, 1897 bp, Homo sapiens
gaaaaggctccaggcacgatgtagaggatcccccgagcagcgccgtggaagtctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagaggggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 323608 - DNA, 432 bp, Homo sapiens
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggtaagttggggatagtgtgatctacccccatgtccttattcttgcaatagctctataagggaaggatcattcagcttttgtagataag

SEQ ID NO: 323609 - DNA, 884 bp, Homo sapiens
  misc_feature (555)..(555): n is a, c, g, or t
  misc_feature (569)..(569): n is a, c, g, or t
  misc_feature (589)..(589): n is a, c, g, or t
  misc_feature (600)..(602): n is a, c, g, or t
  misc_feature (607)..(608): n is a, c, g, or t
  misc_feature (611)..(611): n is a, c, g, or t
  misc_feature (614)..(615): n is a, c, g, or t
  misc_feature (627)..(627): n is a, c, g, or t
  misc_feature (629)..(630): n is a, c, g, or t
  misc_feature (633)..(633): n is a, c, g, or t
  misc_feature (654)..(654): n is a, c, g, or t
  misc_feature (662)..(663): n is a, c, g, or t
  misc_feature (665)..(665): n is a, c, g, or t
  misc_feature (764)..(764): n is a, c, g, or t
gtatcaacgcagagtggtcattacggccgggtcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaaaaaaaaaaaaaaaaaaaaattttgggggccnggcccaaaaagttnttaaaaccattctgtggggncgcggggcccnnnggtannggnccnnggccacaagcgngnnccnaggaaacccgggccagaccangggtgggnntnccccaaaaaaacccggggaccggtgttcgaacacacagaaggttcgggggcctacggtctacaacagggccagcatcatacccccccgcagcggggggnaaacaacacacaccagaagcacaacgaaaacacagaagagaaaagagaaggacacgcagagaaacacgcacagaagcaagacacgacacggaaacagagccacaaacaagacaaagaaga

SEQ ID NO: 323610 - DNA, 818 bp, Homo sapiens
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctgactatgcaatcggaccacttcttatttttggccttgcccccggatttgttcactgggtctttgtctttttggccgactttccagcgtccttcttcttcttgtcgtccttaggcggcattgcgaagctcggagaatagcagcagacaccgcagcctcgtcaagatcctcgt

SEQ ID NO: 323611 - DNA, 6108 bp, Homo sapiens
  misc_feature (5779)..(5779): n is a, c, g, or t
  misc_feature (5793)..(5793): n is a, c, g, or t
  misc_feature (5813)..(5813): n is a, c, g, or t
  misc_feature (5824)..(5826): n is a, c, g, or t
  misc_feature (5831)..(5832): n is a, c, g, or t
  misc_feature (5835)..(5835): n is a, c, g, or t
  misc_feature (5838)..(5839): n is a, c, g, or t
  misc_feature (5851)..(5851): n is a, c, g, or t
  misc_feature (5853)..(5854): n is a, c, g, or t
  misc_feature (5857)..(5857): n is a, c, g, or t
  misc_feature (5878)..(5878): n is a, c, g, or t
  misc_feature (5886)..(5887): n is a, c, g, or t
  misc_feature (5889)..(5889): n is a, c, g, or t
  misc_feature (5988)..(5988): n is a, c, g, or t
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaaaaaaaaaaaaaaaaaaaaattttgggggccnggcccaaaaagttnttaaaaccattctgtggggncgcggggcccnnnggtannggnccnnggccacaagcgngnnccnaggaaacccgggccagaccangggtgggnntnccccaaaaaaacccggggaccggtgttcgaacacacagaaggttcgggggcctacggtctacaacagggccagcatcatacccccccgcagcggggggnaaacaacacacaccagaagcacaacgaaaacacagaagagaaaagagaaggacacgcagagaaacacgcacagaagcaagacacgacacggaaacagagccacaaacaagacaaagaaga

SEQ ID NO: 323612 - DNA, 5713 bp, Homo sapiens
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaa

SEQ ID NO: 323613 - DNA, 4539 bp, Homo sapiens
acagggtcggtcatctccagaatgtgtctagaattggctggtactttttcctactctaataatacacgaaattattgcctgctgttaaaagcctgtatgttttcttatctggataaagaggtaagtgtcacttgtggttttaaaaaaatgtttttctcttgtattttaaaaaatgctttcttacatccttagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaa

SEQ ID NO: 323614 - DNA, 4442 bp, Homo sapiens
aacacaaaagcggcacccattccaagagaagtactttgcatccattaaccccaagctcctgatccctcccactctctccctttccccctgggcagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaa

SEQ ID NO: 323615 - DNA, 1598 bp, Homo sapiens
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgacttt

SEQ ID NO: 323616 - DNA, 319 bp, Homo sapiens
aattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcag

SEQ ID NO: 323617 - DNA, 5771 bp, Homo sapiens
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaa

SEQ ID NO: 323618 - DNA, 5118 bp, Homo sapiens
aatcatatcctagtcctcaatagataattatgagaaaataacatgtaaatgcattttcattttgatattttcagtttacagatatagagcaatagtgttttagatctggattgggaagttaggaatctattttagtagtttctcatcacttagactgaaagaactatggagttggtattctgtttgaattacaaagatgtttttatctcagcagcctgaaaacatactaattttatattaaatcagtttattatttatatttggtaaaattagtacaaaattttcagttaaatcaatttatcgtttgtattcggaaaattagtacaaaataatcattcagtaacttgttcttgtcttccagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaa

SEQ ID NO: 323619 - DNA, 2996 bp, Homo sapiens
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccag

SEQ ID NO: 323620 - DNA, 1833 bp, Homo sapiens
gccagtgaagtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccaccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtaggattatgttaacatcatcttagaagtcatattcaagttttacatgtttaagaatttaatatcggtgtgatacatccccagtatacatctcttggaagagtatatggacataattttatgaacccagttgatgttaaaattccgataagagaaaatgaaaggttcgttaagctcataaggacatactcatctctaaatgtaatgtgctaaaatgactcatttggatatccaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgacttt

SEQ ID NO: 323621 - DNA, 293 bp, Homo sapiens
gcggccgcctactactactactactgctcgaattcaagcttctaacgatgtacggggagctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323622 - DNA, 188 bp, Homo sapiens
cggaaattaattgttagggattacgccgaggggggtccccccatgaccccccccaaaaagtaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323623 - DNA, 891 bp, Homo sapiens
gaggggcacgcttcctgacgaaccaccggctttgcctcccggtgcgcccgctggctacccaggcccttcagcaccattggaacttccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagaaatcagcacactgaggggccaagtggcaggccacgtcagcgcgcaaggcggcaacccgccccgggcacgaacgcccaaaaccgagtgaacatgcgaaccccaagcaggctggccgcaccaaccgcaaggagcacacccggccc

SEQ ID NO: 323624 - DNA, 1052 bp, Homo sapiens
  misc_feature (869)..(869): n is a, c, g, or t
gggctcagatatccgcccctgacaccattcctcccttcccccctccaccggccgcgggcataaaaggcgccaggtgagggcctcgccgctcctcccgcgagcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagacctggggggaatcgcgcggggccagggagccgccggggggggaccgccgggccgatncccaaatcggggtggaacccattaggttggcggcgaccgaggggtggcgcgggcaccggtgggaaagaacgggggtgggccgagacctagaagcggtaggcggccaggtggtgaggcaaaaatggccagaagggggccgtcagaaaagaggggacggttagcctaggacccgttagccacgcg

SEQ ID NO: 323625 - DNA, 961 bp, Homo sapiens
gggctcagatatccgcccctgacaccattcctcccttcccccctccaccggccgcgggcataaaaggcgccaggtgagggcctcgccgctcctcccgcgagcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagggaatcagtacgtgagggcagtggagccagtcaggggggggggtccgttcgggagattgcagattttgtgattggagcattagttggggaaaggagtgtgaaggttcagggaaaaaaggggtgtggaggaccaaaagggttggggctagt

SEQ ID NO: 323626 - DNA, 1737 bp, Homo sapiens
  misc_feature (17)..(18): n is a, c, g, or t
  misc_feature (1444)..(1444): n is a, c, g, or t
  misc_feature (1454)..(1456): n is a, c, g, or t
  misc_feature (1636)..(1636): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaaaaaaaaaaaaaaaaaaaaaaaaaaaaanccggggtttnnntggggggggggggaaaagggggtatggaaggggccaggggccataagtggttccggggcgcccaggttttcttgtgtccaaccgggcgcgaaactgcggggggcccccaatagggggagggggaataaaatacgagaaaccgcagggtaaccgctggttatgagcttcgcggcgagaaanaaatcacaaacccgaccgcacatacacagcccagccacacaccagaacataacacaacacaacataaaccaatattaccgagagctaccctagacaaagaa

SEQ ID NO: 323627 - DNA, 1647 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaggaaggacgtttggtttattatttcagcccatggagagaataggtcgttcggtttgttatttgagcccatggagagatgggtcctgccttggccctgtttaggttttatttgaaccaaagttcactctgtcccaggaaagggaggggagggtactcacatactttgcctgtaatggtaattcctgtttacagaagtcttcatttatttaacccgttccttaaaataacctca

SEQ ID NO: 323628 - DNA, 1514 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagcgaggacttaccggttttctgactgcataaatttgtccggaaaaaaaaaaaaaaaacagcggcttgggggcaaagaaggcaggtaggtcgcatttaaggggggctgagtatagtcattagaagaagataagacgaaaaaaaaagaaaagaaaccacca

SEQ ID NO: 323629 - DNA, 1440 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagcgctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtctcgaggacttaccggttttctgactgcataaatttgtccggaaaaaaaaaaaaaaaacagcggcttgggggcaaagaaggcaggtaggtcgcatttaaggggggctgagtatagtcattagaagaagataagacgaaaaaaaaagaaaagaaaccacca

SEQ ID NO: 323630 - DNA, 1271 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323631 - DNA, 1106 bp, Homo sapiens
  misc_feature (17)..(18): n is a, c, g, or t
  misc_feature (1070)..(1070): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagatccgcttntccgtcgacggatagcggatctgcatcgctttcatc

SEQ ID NO: 323632 - DNA, 1526 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccgggggtaggtagagggaagcaggcaccctttgggggttaggaaggggagggcttggtgttccctacgcgaaggtctgactcaatgcttattccctcttcttcctctctctgcagactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323633 - DNA, 997 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggagcggatggaaaatgaccgggggtgcgtgggcccggaggaccgaataagcgccgggttggcgggggcccccggtgtgaagggggccgtgc

SEQ ID NO: 323634 - DNA, 1306 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323635 - DNA, 1098 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgcggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323636 - DNA, 1720 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgacgacccagtctgtcccccagtgctagttactaggcctgcacctgaaaactaagcccctttagcctgaagggtggggaagtgacctgggccaggcccagtggggtctgggccctgacatgcccatctctgctgtatcttttcaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323637 - DNA, 1605 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtgagtgtctctgtcctgggggctgcagaagccaggactggggtaggggttggggggtttagaatctgccctcacctagcctagatggcctgaagctaacccccctatggactcctgaactctggggaggtagggaagtcttcagagatgctgaggaagctctgcctggctgcaactatttcctttgaaaggtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323638 - DNA, 1865 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgacgacccagtctgtcccccagtgctagttactaggcctgcacctgaaaactaagcccctttagcctgaagggtggggaagtgacctgggccaggcccagtggggtctgggccctgacatgcccatctctgctgtatcttttcaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatggtatgtgtccccccaccgccgccgcttccctgtgcaattcacacttatacccttgcagcctagggcagcctggccggtggctgtgcccatgccctctccgggaaccaggctctgctgagtcacaaccccctctccctatcctcagaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323639 - DNA, 1054 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgacgacccagtctgtcccccagtgctagttactaggcctgcacctgaaaactaagcccctttagcctgaagggtggggaagtgacctgggccaggcccagtggggtctggacctgtcctgcgacctatagagatccgctagagtcgcc

SEQ ID NO: 323640 - DNA, 785 bp, Homo sapiens
  misc_feature (17)..(18): n is a, c, g, or t
  misc_feature (754)..(754): n is a, c, g, or t
  misc_feature (758)..(758): n is a, c, g, or t
  misc_feature (761)..(761): n is a, c, g, or t
  misc_feature (768)..(768): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagagaatagtnccgnggncaggggngccggcaggagggacga

SEQ ID NO: 323641 - DNA, 717 bp, Homo sapiens
  misc_feature (17)..(18): n is a, c, g, or t
  misc_feature (688)..(689): n is a, c, g, or t
  misc_feature (691)..(692): n is a, c, g, or t
  misc_feature (695)..(696): n is a, c, g, or t
  misc_feature (698)..(698): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggtnnannagnnanggggatcgctctagagtcg

SEQ ID NO: 323642 - DNA, 927 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaaatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggtgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323643 - DNA, 1414 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323644 - DNA, 858 bp, Homo sapiens
  misc_feature (8)..(8): n is a, c, g, or t
  misc_feature (27)..(27): n is a, c, g, or t
  misc_feature (30)..(30): n is a, c, g, or t
  misc_feature (416)..(416): n is a, c, g, or t
  misc_feature (449)..(449): n is a, c, g, or t
  misc_feature (452)..(452): n is a, c, g, or t
  misc_feature (845)..(845): n is a, c, g, or t
tggatcgnttattactttactacctantgnagcactcgactctttggatccccaacccatgtgccgctccgggcaccgatctcgccaagatcctgagtgatttgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagngagcggcagaatcaggagtaccagcgcctgganatngtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagcaacgggtatcctcaagagtcgaggagcatactaatgtcatcagtggagagaaagcnaaatatagtgccc

SEQ ID NO: 323645 - DNA, 760 bp, Homo sapiens
  misc_feature (729)..(729): n is a, c, g, or t
  misc_feature (733)..(733): n is a, c, g, or t
  misc_feature (736)..(736): n is a, c, g, or t
  misc_feature (743)..(743): n is a, c, g, or t
taatgtgcaatcgacgggacgagatcaggattacatcagtggtcgactcggccgtcaaccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagagaatagtnccgnggncaggggngccggcaggagggacga

SEQ ID NO: 323646 - DNA, 252 bp, Homo sapiens
ctctagaggatctcccctgtcgacactccaggactgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggtgtcgaacaggtagcgagctcgattc

SEQ ID NO: 323647 - DNA, 1409 bp, Homo sapiens
  misc_feature (17)..(18): n is a, c, g, or t
  misc_feature (1386)..(1386): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagagcgcccccggtataacttcctgcgggggncccatgccaatagttataggtgt

SEQ ID NO: 323648 - DNA, 1365 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagcgctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323649 - DNA, 1170 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctcatacacgcggatcatgctcactcaagtcagaggcccca

SEQ ID NO: 323650 - DNA, 1559 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatggtatgtgtccccccaccgccgccgcttccctgtgcaattcacacttatacccttgcagcctagggcagcctggccggtggctgtgcccatgccctctccgggaaccaggctctgctgagtcacaaccccctctccctatcctcagaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323651 - DNA, 1792 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatggtatgtgtccccccaccgccgccgcttccctgtgcaattcacacttatacccttgcagcctagggcagcctggccggtggctgtgcccatgccctctccgggaaccaggctctgctgagtcacaaccccctctccctatcctcagaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaggaaggacgtttggtttattatttcagcccatggagagaataggtcgttcggtttgttatttgagcccatggagagatgggtcctgccttggccctgtttaggttttatttgaaccaaagttcactctgtcccaggaaagggaggggagggtactcacatactttgcctgtaatggtaattcctgtttacagaagtcttcatttatttaacccgttccttaaaataacctca

SEQ ID NO: 323652 - DNA, 1296 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagtgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323653 - DNA, 1095 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaagcaggaagcagccagcagaagcgaaggcgggg

SEQ ID NO: 323654 - DNA, 1113 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgcttggaatccacctccacactgacctggcctcccacttggcccctcagcgtactgatttcctcctcatggttc

SEQ ID NO: 323655 - DNA, 1160 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323656 - DNA, 1393 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccgggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323657 - DNA, 1671 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccgggggtaggtagagggaagcaggcaccctttgggggttaggaaggggagggcttggtgttccctacgcgaaggtctgactcaatgcttattccctcttcttcctctctctgcagactgaagaattgaaccgggaggtcgctggccacacggagcagctccagatgagcaggtccgaggttactgacctgcggcgcacccttcagggtcttgagattgagctgcagtcacagctgagcatggtatgtgtccccccaccgccgccgcttccctgtgcaattcacacttatacccttgcagcctagggcagcctggccggtggctgtgcccatgccctctccgggaaccaggctctgctgagtcacaaccccctctccctatcctcagaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323658 - DNA, 1029 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323659 - DNA, 1431 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagaaatcagtacgctgaggtgggggccacaaagggtgggggggaacgggggcccaagggttccaagggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323660 - DNA, 1832 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgacgacccagtctgtcccccagtgctagttactaggcctgcacctgaaaactaagcccctttagcctgaagggtggggaagtgacctgggccaggcccagtggggtctgggccctgacatgcccatctctgctgtatcttttcaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccgggggtaggtagagggaagcaggcaccctttgggggttaggaaggggagggcttggtgttccctacgcgaaggtctgactcaatgcttattccctcttcttcctctctctgcagactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323661 - DNA, 1233 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 323662 - DNA, 986 bp, Homo sapiens
  misc_feature (17)..(18): n is a, c, g, or t
  misc_feature (803)..(803): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagacctggggggaatcgcgcggggccagggagccgccggggggggaccgccgggccgatncccaaatcggggtggaacccattaggttggcggcgaccgaggggtggcgcgggcaccggtgggaaagaacgggggtgggccgagacctagaagcggtaggcggccaggtggtgaggcaaaaatggccagaagggggccgtcagaaaagaggggacggttagcctaggacccgttagccacgcg

SEQ ID NO: 323663 - DNA, 895 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagggaatcagtacgtgagggcagtggagccagtcaggggggggggtccgttcgggagattgcagattttgtgattggagcattagttggggaaaggagtgtgaaggttcagggaaaaaaggggtgtggaggaccaaaagggttggggctagt

SEQ ID NO: 323664 - DNA, 810 bp, Homo sapiens
  misc_feature (17)..(18): n is a, c, g, or t
  misc_feature (755)..(755): n is a, c, g, or t
  misc_feature (757)..(757): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggagtgctactgananaactgaggggaatcgcacgagggcatggagccagccggggggaacgccggccg

SEQ ID NO: 323665 - DNA, 1049 bp, Homo sapiens
  misc_feature (17)..(18): n is a, c, g, or t
  misc_feature (1013)..(1013): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgtccgtgctccgcctcgccatgacttcctacagctatcgccagtcgtcggccacgtcgtccttcggaggcctgggcggcggctccgtcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagatccgcttntccgtcgacggatagcggatctgcatcgctttcatc

SEQ ID NO: 323666 - DNA, 706 bp, Homo sapiens
  misc_feature (17)..(18): n is a, c, g, or t
ttaggtacgaggccggnngttaatcggcacgagggcgaatcgcagcttctgagaccaggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagggtgggcggaggcccggccgcgggaagtgcagtgcacctgccgcggaaacccagccccgcgggccgggcgaggttccaggcggggcggcgggcaggagcccgttaggacgtgggaaggtccacaggtggggccgagtaaagggggacaggagacgtgcggggcaggacctcggggctggatgcagaggccggggtggtgga

SEQ ID NO: 323667 - DNA, 875 bp, Homo sapiens
ctgatgaagtaccctgtgagatagagtctgcaacacccccatttcacagcgtaggagactgaggcacagtgaggttaaactcacctaaagtctcagccagagttgttgaataaatgagaccctgaccaagctcagatacgccccagagacgtacccagggctcgctccctcacgtcttcctagcctgggctcaaatgtcacctgctggtgaccagaccaccttccctgagtagcacccttcacccccactctcacacctgtctctgtttcatttgctcctcggcagttagcagcgtctggcatcctctgttttactctctgtctgctgctttggaatgtaagctctcagagatcagaggcattgtctgtttccatcatgctgatacctacctcctaaaaaagtgcctgggacagggttggtgctcagtaaatatccgtcgactaaacaaatgaaggcatgactcaaagcactggctttcagcaccagacgaggttttcctgggctgctgtcaccgggcccagcaggggcaccctggcactttctcctgccatgacaaactcccactgaattggactgtattcccaccacacatggatgacattctccaacacatgtgccccatgtgccattacctctttccagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccg

SEQ ID NO: 323668 - DNA, 1268 bp, Homo sapiens
ctggtacgccccggacgtacgggatcccggacggaggacagtgccggccgccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggaggagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccg

SEQ ID NO: 323669 - DNA, 1238 bp, Homo sapiens
ccccgtgctccagaggaaactccgtgcccaactgggggctccccgccccgctgaggggcgccgcccaggagggtcccccgcgccccgcgggccctggcaggatgcacgccgccctggcggggccgctgctcgccgccctcctcgccaccgctcgcgcccgcccgcagcccccggacggaggacagtgccggccgcccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggaggagtgtgcgggccgggagcctgcaggcctcctacaccacggaggacctcatcaagcactacaactgcggagacctcagcgcagtcatcttcaaccacgacacatcccaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccg

SEQ ID NO: 323670 - DNA, 1413 bp, Homo sapiens
ccccgtgctccagaggaaactccgtgcccaactgggggctccccgccccgctgaggggcgccgcccaggagggtcccccgcgccccgcgggccctggcaggatgcacgccgccctggcggggccgctgctcgccgccctcctcgccaccgctcgcgcccgcccgcagcccccggacggaggacagtgccggccgcccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggaggagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccg

SEQ ID NO: 323671 - DNA, 1110 bp, Homo sapiens
ccccgtgctccagaggaaactccgtgcccaactgggggctccccgccccgctgaggggcgccgcccaggagggtcccccgcgccccgcgggccctggcaggatgcacgccgccctggcggggccgctgctcgccgccctcctcgccaccgctcgcgcccgcccgcagcccccggacggaggacagtgccggccgcccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtaggcatgcagtgccccagcccggagctgacagccctgggtacctgggtcctcttctctgattgtctttcttctccgagggggagggggaggcagccagagtcaggtcctttttctggaaggagaggttctgctgggcagcgaggcagcacctggctgctctggtggtatcagttgagagtggcgtatactggaatttggggtaagagtctgcgtgtttgcttctatttcagcagtattacatgttggggatgtacactcctcacctgctgtgcttgcctgggcagaaagaatttccctcagagcatcagagagagcctgcaggtaccgagctcgattctaa

SEQ ID NO: 323672 - DNA, 336 bp, Homo sapiens
cagtcccgggactgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccg

SEQ ID NO: 323673 - DNA, 2371 bp, Homo sapiens
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacctggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgctttttccctacccttcctcgattctgtccgtgaaatgaattgggtagagtctctggaaggttttaagcccattttcagttctaacttactttcatcctattttgcatccctcttatcgttttgagctacctgccatcttctctttgaaaaacctatgggcttgaggaggtcacgatgccgactccgccagagcttttccactgattgtactcagcggggaggcaggggaggcagaggggcagcctctctaatgcttcctactcattttgtttctaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgactaacgaggct

SEQ ID NO: 323674 - DNA, 2034 bp, Homo sapiens
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacctggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgactaacgaggct

SEQ ID NO: 323675 - DNA, 1350 bp, Homo sapiens
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggaggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgactaacgaggct

SEQ ID NO: 323676 - DNA, 1889 bp, Homo sapiens
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacctggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgaggtgaggggctgcgccacagacgaacgccttgcgctgctggctgcttttacccatctccgtggtgcagttggcccgattccttgatgcatttccctggtcggtctctcttaccccggtagctggttttgggttcccctttgtgatgggtaggggaaaacaagatctgagaatttaaa

SEQ ID NO: 323677 - DNA, 721 bp, Homo sapiens
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgcgtgagtcctgcgttcgaccccaccccgtc

SEQ ID NO: 323678 - DNA, 2006 bp, Homo sapiens
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacctggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgactaacgaggct

SEQ ID NO: 323679 - DNA, 806 bp, Homo sapiens
  misc_feature (700)..(700): n is a, c, g, or t
  misc_feature (706)..(706): n is a, c, g, or t
  misc_feature (708)..(708): n is a, c, g, or t
  misc_feature (723)..(723): n is a, c, g, or t
  misc_feature (730)..(730): n is a, c, g, or t
  misc_feature (756)..(756): n is a, c, g, or t
ccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgcggtgtgcnagaggntnagcctgacatgctcntgtgacngccgggatgcgatctaagggtgatgnccctctgccggcctgtttcacagggttgctcgccgggcgtcttggtcccg

SEQ ID NO: 323680 - DNA, 87 bp, Homo sapiens
agatgtgcagcgagtggccgggggacatgagggaggcaaacctgaaaaccttcaaagaaacctgtagacagttctagagttaaaggt

SEQ ID NO: 323681 - DNA, 6229 bp, Homo sapiens
gagagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttc

SEQ ID NO: 323682 - DNA, 756 bp, Homo sapiens
agatgctgtagtggatggagggacgggtggcgaggcatcagagtgattccttggggctgtggtcacggtggtgaaaatgggaagcagagggatttgggagacagatcagagagggtgtgaggggctgaccatcaagatgtgatgacagctgagagatggacctgtggctcatccatttctcccagaagcagcatcttatctcaagggcagtcatgtttctgtctcattgccaaggaaaatgccatctgtcccctccagtgggctctgcctgtaatgtgtaagctgcgtggttttaggtcacgtccacacattgctaacgtaaccctcacggtgggggacaaggagggctgcgggctgggaagtggcccctgcccccaggtgtttgcctgcgcatcgtcccccatgtttccttagtgtcagctgggagtgctgccgctcggcacagggaacgacttggcccgagtactgggctggggctcagcctgcgatgacgacacccagctcccccagatcttggagaagttggagagagccagcaccaagatgctggacaggtgagtggggatgtgctccggtgccgtatgaggagactttgagagacaggtccctttgaccaggtgttcttaacctggggtctgtggaaaacatgggccctctgaaattatttgtaaagatttgacctgagtatatattcggatagtctttgatatttggtcagattatgacaaggataaaaacaaaacaggttaagaacca

SEQ ID NO: 323683 - DNA, 6820 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323684 - DNA, 6700 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacaggtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323685 - DNA, 6024 bp, Homo sapiens
agatgctgtagtggatggagggacgggtggcgaggcatcagagtgattccttggggctgtggtcacggtggtgaaaatgggaagcagagggatttgggagacagatcagagagggtgtgaggggctgaccatcaagatgtgatgacagctgagagatggacctgtggctcatccatttctcccagaagcagcatcttatctcaagggcagtcatgtttctgtctcattgccaaggaaaatgccatctgtcccctccagtgggctctgcctgtaatgtgtaagctgcgtggttttaggtcacgtccacacattgctaacgtaaccctcacggtgggggacaaggagggctgcgggctgggaagtggcccctgcccccaggtgtttgcctgcgcatcgtcccccatgtttccttagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323686 - DNA, 5596 bp, Homo sapiens
ccagatggggctcacagccaggtggaaacagcctctgctgcaaacggacccaaacctggagccgacccgccagcatgccgctgtcaggatgagtaggggtcaggacggaagctcctagcacaggccgtgctgggatcgcagactgaaggagattcatttgcagtttgcctgcagcttgacgaagcttttaaaatctctcacctagcactaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323687 - DNA, 4269 bp, Homo sapiens
cggggatgtgtggagtggtggtcagctctaacgtgtcccttgcagactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323688 - DNA, 1552 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtgagtggggatgtgctccggtgccgtatgaggagactttgagagacaggtccctttgaccaggtgttcttaacctggggtctgtggaaaacatgggccctctgaaattatttgtaaagatttgacctgagtatatattcggatagtctttgatatttggtcagattatgacaaggataaaaacaaaacaggttaagaacca

SEQ ID NO: 323689 - DNA, 441 bp, Homo sapiens
agccctccaggtggtacctgggccgtgttcagatgcgtattgtgaaaggctgcccttccatttggcctgacatctgcccgtgcttctcttcctctctagtatccgagaaatagctcagtctcaccgggacatggagcaggaactggcccacgccgtcaatgccagctccaagtccatggaccgtgtgtatggcaagcccagaaccacagaggtagctattctggccttttcagtcctggcttcttctcagtgtctgccgccctcggccctccccgtgcgtgttcattcccccgcctccccggtgcatgttcggccctcccagtgcttgttccctgcccctaaccgtgcatgttcggccccccgcccccatgcatatttgcctggtttcttctaggggctcaactgcagcttcgtcctggaaatggtgaataacttcagagc

SEQ ID NO: 323690 - DNA, 204 bp, Homo sapiens
ggatcttgccaagcgcagtcgcagtggtaaattccgcctcgtgaccaagtttaaaaaggagaaaaacaacaagaacaaagaagctcacagtagcctgggagccccgggtacctgcctctctcccgcgtgtgtttctggccgtccacgcctgctggatcggccccgttcccctggtctctgctttctcccttggccttgcagctc

SEQ ID NO: 323691 - DNA, 497 bp, Homo sapiens
acttgcctagcacatctggctgccaggaggaagccaagacacaggggacacatagaggcacatggccccaggagccctcaccctcgtcctgaaagtttgaggtagctgtggtcgaagggccagaaggttgggtacaggactgtagctcacacggtgtgaagcatgactggctcctgccgggtatttccgtgttatgccttctcaagtgcaaagccagggcccagggcccccgatgatagcaggccggcccagggcccctgatggtagcaggccagcccagctctgaaatcacctgcctcccccgaggccagctcatcagctacagggcaggaggatttctggtgtgtgtgaaggatgccagtgacccttggtgacgcggggactcttgtttcaggttcacacatcgtgtaaagaatccttgctgaccaagtgcccacttggcctgtgcaaagtgtcagtcatcccacccacggctctcaacagcatcgactccgatg

SEQ ID NO: 323692 - DNA, 6297 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttc

SEQ ID NO: 323693 - DNA, 567 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaaggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgaaaggggatggacacacgtagggggatggacacacgaaaggggatggacgcccgaaaggggatggacacagggggccgagctc

SEQ ID NO: 323694 - DNA, 6628 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaaggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323695 - DNA, 5442 bp, Homo sapiens
gtcatggagcttgctgtcacagagaccaacagtcctggccatttggggtgattgcaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323696 - DNA, 3968 bp, Homo sapiens
tgcaaggttcgactgctgactttgcttcccacagcatttccactgcttgacacaggtgaatggctccgaccccatttctgacagagggacacaagcaggtcagttgtcagccttgctctatgtgaattcatcgttgactgatggacagttttattctctcaccagcactacttagaaagtgaggttctgggtttggttccttttctggtgctctgggacttcgtttctggaaagtgagctccctgatcagagcagagcagagccctggagcggacctcacccccctgggcctcgcgctgatcagcagtgcacactctccatttctctctccctccctccgcctggagcagcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcaaaaaaaaaaaaaaaaaaaaaaaaaaaaaaaaaaaaaaaaaaaaaaaaaaaaaaaaaaaaaaaaaaaaaaaaggggggggggggcgaaaaaccccggaggggggacaccatagatacgatagcacaacccaccatgttgttgttgtgagaacaaggggtggcccccaaagaggagggctgcattaatataaaagcagatgagagagggagagggggcggcgggattgttataaaaaagcggtgtggggaggtgggagaaacaagtgcggttattggtgcggacttgtgtggaggaggaggagagaacccccatttgtgggggggggtgagaacacaatagtggggggacacacactcctacaagaagagatattatacaggcctggagggcggaagaaatatcaaaacttggaagggggtgttatttgaggtggtgtaaaccacatgactggatgatgtttgtggcgtgcgtggaaagagattcgggtcacgggcgatagtgttctaggaaaaacattagagg

SEQ ID NO: 323697 - DNA, 5399 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagctcgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtagaggtacttcatatgagtgcgccttgctgtaacttgcggggttgcctataaccgctctgggtgtgccctgtggctcgaacaggcgggagtacaccactgtggcacatttccactcagagcctctggccctctgggaggccacacaggggccctttttgggcctttggggggctcctttctgggggctttgtgcccagggctataagatgtggttgtcaccactttggtttccccacaacatcttgtgtcgatacgccacttggagaattgggggtgtt

SEQ ID NO: 323698 - DNA, 1278 bp, Homo sapiens
agcggggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacaggtaccaggacaggagggagcccagccaggagcagagagggtgcggaggttagagggaaatcatgcagt

SEQ ID NO: 323699 - DNA, 266 bp, Homo sapiens
cgtggcctatatattttcttctgttcgttcttgcgtccagggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcgggtaggaagcttgtaaaatatatctttcttggagttttaaaaattgtgtagatagtgtgtgctt

SEQ ID NO: 323700 - DNA, 531 bp, Homo sapiens
tgaaagccctgtgaggggcggctgtgggcggaggccacgcaggaagagtgcttaggagtaacttgtttctaacacctgtgtgctgagtgccaatgctgggtgtggtgttatgatatatattggttttcatccagcattcctgactcgtaactctcatagtccttgttccagtctttgttagaatactgggtatgttagggcttgggacaggcctctgacctctgggtatcctttcactaatgttcgcccacctttttcacagtgggtcctaaagaccttcccatgagagggtctcaatcctaggggaaggaatgttgatgtcatgaaccttccataaaaacccaagaggacagggttcagagagcttctggatagctgaacacctggcacttcctggagtgtggcgtgcccagggagggcacggaagctctgcactccttccccttccctcattccttgctctatgtgcatctcttcatctgtatcctttgcgatatcctttataataaaccggtaaacataaaaaaaaaa

SEQ ID NO: 323701 - DNA, 2601 bp, Homo sapiens
agccaatcgggctcgatgaggaagacgtgagtcagagcttgcgcctctcgcttccagctgtgggtggcgctaggcagcttcagccggaccgggtaggggtcctcgctcgctagcttgctgtttctcggagaagctcccgagtgtccggcctagaggccatgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctggccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcgggggccgtgccaaaggtgcgccattgctggtctgcggctcccctttcggcgccttctgccccgacatctttctcaacacgctgagctgcggggtgctcagcaacgtggccggcccactgctgcttaccgacgcacgctgccttcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctggtcggcacgtgtcccctcgggaagcagccagggtcctggtgcgctccaccacccccaagagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323702 - DNA, 1939 bp, Homo sapiens
ttggaagctacccctgcagagtgtgtagtaggacgcccctgtctgatcccgggcaagtcacttaacctgtctaagctgcctccccgggagttgacgctgaatgtcgtggaacggagcctgtcacgtcgtgtgctacagaagtgttagcgtgtacgtaaatagggacccagaggagtgaaaccatgtcatatctgacccaccaactgacgggattgttgtgggtatcaacgaggcagtgaaggaaagtgttgtgtttgccttggctcctcccactttgtttggtgttgggaatgttactgagcgtctctgggcctcagttataccacctaaaatggagataatgccagtgcctagtttatagggtcgtgaagactaaataaagtgatgtccacaaagcactaacaccaaacctggcccacagtgctcactaagtgtcaggttgattattcaggtacaggaagctttagagaagtagcacagtttgtcaaccacctcttggagataccacagaatggttacatgacttgcccagagttgcctgctggtcgattcagggctgatacccagatcttctgacttttactgtcactctcagctccttgatttctcccaagtactgaggagtcagaaagctagcctgtcatttgtttcccttgctcccaggagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323703 - DNA, 1330 bp, Homo sapiens
acaggctgtactggtctggaattttaggatgcgctaggcagcacagccggacgggagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323704 - DNA, 1279 bp, Homo sapiens
agccaatcgggctcgatgaggaagacgtgagtcagagcttgcgcctctcgcttccagctgtgggtggcgctaggcagcttcagccggaccgggagtgtggccatctggggccgtgtggtatttgccactcaggagacatgtccctatgacatagcagtggtgagcctggaggaggacctggatgatgtccccatccctgtgcccgctgagcacttccatgaaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323705 - DNA, 1051 bp, Homo sapiens
agccaatcgggctcgatgaggaagacgtgagtcagagcttgcgcctctcgcttccagctgtgggtggcgctaggcagcttcagccggaccgggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323706 - DNA, 283 bp, Homo sapiens
acaaggactagggaacagcctgttgctcagaagtggtcatgcagatacagtgctaggagctcagtggagttctcagcctcttccagccaggggacatggggaaggctctctggaggcaggagtatctgagcagaaacttgaagggtggagaggtttggaatgtttggagagggtagggatgggagttagggagtgtgagtcctgctgtaacacaggtgtccccagcttcaccctccttccttccctggcagcgaggctgtgagtgtggtgggctttggcgtct

SEQ ID NO: 323707 - DNA, 375 bp, Homo sapiens
ggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggtaaccagctctttggccccctcccgccctcccacttgccagaacctcagtcccaccccatgagtgcttgtggccagccccagtgcaccctctgtctgggaaaatggtgggcattatgagtgagctagcgaaggtttgcaggctgttctcctgatggtggagagggacggatgctggactgggaggaaagagatctgggctctggtcccttctctgctactaatctaatctggtttg

SEQ ID NO: 323708 - DNA, 2284 bp, Homo sapiens
agccaatcgggctcgatgaggaagacgtgagtcagagcttgcgcctctcgcttccagctgtgggtggcgctaggcagcttcagccggaccgggtaggggtcctcgctcgctagcttgctgtttctcggagaagctcccgagtgtccggcctagaggccatgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctggccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcgggggccgtgccaaaggtgcgccattgctggtctgcggctcccctttcggcgccttctgccccgacatctttctcaacacgctgagctgcggggtgctcagcaacgtggccggcccactgctgcttaccgacgcacgctgccttcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctggtcggcacgtgtcccctcgggaagcagccagggtcctggtgcgctccaccacccccaagcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323709 - DNA, 1368 bp, Homo sapiens
agccaatcgggctcgatgaggaagacgtgagtcagagcttgcgcctctcgcttccagctgtgggtggcgctaggcagcttcagccggaccgggagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgt

SEQ ID NO: 323710 - DNA, 2696 bp, Homo sapiens
agccaatcgggctcgatgaggaagacgtgagtcagagcttgcgcctctcgcttccagctgtgggtggcgctaggcagcttcagccggaccgggtaggggtcctcgctcgctagcttgctgtttctcggagaagctcccgagtgtccggcctagaggccatgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctggccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcgggggccgtgccaaaggtgcgccattgctggtctgcggctcccctttcggcgccttctgccccgacatctttctcaacacgctgagctgcggggtgctcagcaacgtggccggcccactgctgcttaccgacgcacgctgccttcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctggtcggcacgtgtcccctcgggaagcagccagggtcctggtgcgctccaccacccccaagagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaagtgggtcctaaagaccttcccatgagagggtctcaatcctaggggaaggaatgttgatgtcatgaaccttccataaaaacccaagaggacagggtttaaaaaactttttgaaaagttaaccccttgccctttcttgaatttggggttcccaaggaaggcacggaaagtttgccctcctttccctttccttcatccctggtttaaggggatttttttatttggatcccttgggaaattcttttttattaaaccggtaaccttaaaaaa

SEQ ID NO: 323711 - DNA, 2450 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacaga

SEQ ID NO: 323712 - DNA, 846 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaaggtacaggattatccctgtggctaagggagctttgatggaaatcagcctcctcttcactgggggccacctagtttctagaactgaaacagaagctggagtccaggaagcaggcccctgcagttctgttcttacttcagtccctgattattgtcaggtactgactggcttctctgttgcttctaactatagactctcattccttcacttttatcacagaaggttattattatacacatatataattttcattaaaaaaattaaaataggccagatgcagtggctcatgcctgtaatcccagcactttgggaggccaaggcaggaggattg

SEQ ID NO: 323713 - DNA, 877 bp, Homo sapiens
tggtggggaaagcatttcaggctaaggaaataacgtgaagcacaggggaaagatatcccaaagtatggaagggagcaggagcaggattatagcatgcttgaaaggcgttggtgaggaatgaggctggtgtgggtgggaccacgtcacagaggaggttctgggtggccttggccagtctcatcataggggagcttttggatgcacatatttctacccatgctaaccctcctgtccactcagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacagtgagtgcctcacaagtgggtgggtagaccttgccttggacccagctcctgctctggatatgagaggagggagggttgtgtttttgcccagagtattaaaacaaacctgggctcttgtcctgcctgctgactgcttccgtctgagacccctgggaggcctgggtccctgctatatgacgggtgggacctgcatgctctgggaaagatttctgccatcctctggggtagggttgcttgtgggggccacagcaggcagggttggcctctcaacagatggcctgcaggtctcctggcctcagttaagccagggccccaggggtctgacactgagtttttcaacgtctgttctctttttctttctgtctgccttgccccacttctgtccctccaccctgggagcaccatcgccgctggggtttctctctcgtttgctctgctttcctgctgctgctgctcctgtctcaa

SEQ ID NO: 323714 - DNA, 764 bp, Homo sapiens
ttatgggccccctgaagtatccttttttctagaacattctgaaagtcatccttgcctatgggaagcctaggccggcctgcactgttatgttcaataaataagcagggtgctctgggctggggattgtgtgaggagcagagcgcagcccgtcctcatgcttttccactgaagtaggccaggcagagagggagtacagcaatggatgcgctttggcagctgagtagtccgagagccagaaaagaaatgtggaaaataagaacgctgtagcaggcctaggtgaggaaatttaggaagggtttgcgggaggtaggatttgagatgggtcttggagagttggacagtgtcagccggtaggacgggggtgcggacggaagcctgtgaggaaggcagaggatgcggagctgtgaggaagggaacgatgccagatcttgagtttaagaacttgaatcttgtaaagtaccaaatctaataaaatactcgtcctaaatcattactggcccaagcatgcagtgtttccgtggccgacagactcgagccagcgctgtccatggtaaccagcttttgtgtggcttaaagcttgcatccattttctcctttcatcgttttcccaaaacaattccgtgagggctgttagccctgcttggtagacgaagaagccgatgcggtctagggtcacggccagggaggctttgggacgccaagtcagctcggcggtcaccacaccacctacagggctcgtcgggccctcggggtcggcggctgct

SEQ ID NO: 323715 - DNA, 3256 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagaaaaaaaaaaaaaaaaaaaaaaaaaaaaaaaaaaaaaaaaaaaaaaaaaaaaaaaaaaaaaaaaaaaaaaaaaaaaaaaaaagggggggggggcgccaaaaaatcccccgagcggggggggacacacataggagaccactccccagattgttgtgaaaaagagagggcccccataggaggggagatataatataaacaagaaggagcgggcgggcgccgcgaataaaaccagcgacgagagcgggggaaacaagctgtcacagggggaacactcgggaggcgagaacgcccccctacggcggggggggggggacacactaaggcgggcaacacacctcctccgaggaatatactagaccgcccgcggaggggaaaaaccaaacctctcgcaggggagacgaagcgggttaaaacacacgcgacatacaatcgacgcgcgggatgagaaagatgatggcaccagagggagagtagtgctatgaaagcaaattataccgcggggggggtctcgtgctacacccggacaaacaccaagaaagggccgaaaacgacgaaagaaaacgaaaaacacaacaagaaaaaaagagaaaaaaaaaaggaagaaaaaaaaggagagagcaaaagaaacaagagaaaacagaagaaaaaaacaaaacgaaaaaaaaaaaaaaagagaaaaaaacacaaaaacgaaaaaagaaaaggaacaaaaacacacagaagaaaaaaaaagaaaaataaagagaccaaaagaaaaaaacgaaaaaaaaagacagaaagcagacaaaaagaaaacaaaaaaagaag

SEQ ID NO: 323716 - DNA, 3343 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaataaaaaaaaaaaaaaaaaaaaagggggggggggcgccaaaaaatcccccgagcggggggggacacacataggagaccactccccagattgttgtgaaaaagagagggcccccataggaggggagatataatataaacaagaaggagcgggcgggcgccgcgaataaaaccagcgacgagagcgggggaaacaagctgtcacagggggaacactcgggaggcgagaacgcccccctacggcggggggggggggacacactaaggcgggcaacacacctcctccgaggaatatactagaccgcccgcggaggggaaaaaccaaacctctcgcaggggagacgaagcgggttaaaacacacgcgacatacaatcgacgcgcgggatgagaaagatgatggcaccagagggagagtagtgctatgaaagcaaattataccgcggggggggtctcgtgctacacccggacaaacaccaagaaagggccgaaaacgacgaaagaaaacgaaaaacacaacaagaaaaaaagagaaaaaaaaaaggaagaaaaaaaaggagagagcaaaagaaacaagagaaaacagaagaaaaaaacaaaacgaaaaaaaaaaaaaaagagaaaaaaacacaaaaacgaaaaaagaaaaggaacaaaaacacacagaagaaaaaaaaagaaaaataaagagaccaaaagaaaaaaacgaaaaaaaaagacagaaagcagacaaaaagaaaacaaaaaaagaag

SEQ ID NO: 323717 - DNA, 2492 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacaatagtttcaaacaaaagcatacctcgaaagcgccccagagagtttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacaga

SEQ ID NO: 323718 - DNA, 2282 bp, Homo sapiens
acaacaacgaatgacaatctgtagcaagactaaaaaaaatgagaagagtccaaataaataaaaccagagttgaaaaaggagacattacttctgatactacagaaattcaaaggatcattagtagctactataagcaacaatataccaatacattggaaaatctaaaagaaacggacacattcctagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacaga

SEQ ID NO: 323719 - DNA, 1592 bp, Homo sapiens
gtgatttgatcaattaggagctctgaaaggacccaagtgagaaatgacagtgactggatctgcggtggagaggggcagcatggtttcccacataagattctcacatctgttcttacctgctacctacccctcttggaaatagcagtgtcctgtagtggcctgaggcacatcagttattcagtccccatcctcttccctcttgcctacttcaggaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacaga

SEQ ID NO: 323720 - DNA, 1155 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacagtgagtgcctcacaagtgggtgggtagaccttgccttggacccagctcctgctctggatatgagaggagggagggttgtgtttttgcccagagtattaaaacaaacctgggctcttgtcctgcctgctgactgcttccgtctgagacccctgggaggcctgggtccctgctatatgacgggtgggacctgcatgctctgggaaagatttctgccatcctctggggtagggttgcttgtgggggccacagcaggcagggttggcctctcaacagatggcctgcaggtctcctggcctcagttaagccagggccccaggggtctgacactgagtttttcaacgtctgttctctttttctttctgtctgccttgccccacttctgtccctccaccctgggagcaccatcgccgctggggtttctctctcgtttgctctgctttcctgctgctgctgctcctgtctcaa

SEQ ID NO: 323721 - DNA, 390 bp, Homo sapiens
cccctcttggaaatagcagtgtcctgtagtggcctgaggcacatcagttattcagtccccatcctcttccctcttgcctacttcaggaccagttgctcttctgtgatgactgcgatcgtggctaccacatgtactgtctcaccccgtccatgtctgagccccctgaaggtaagttgcccagatcttttactcagaacaattactttattagttacttggaaaatactgagttctatgttctttatgttatcacttacatattcttccaaattagggagtaaagcaccttgccttggctcagtttagaatgccttcctaacatttcaacttaaagggtttagtgtttgcacattatcagctacatttacaacagaaaatcaacagcccaga

SEQ ID NO: 323722 - DNA, 266 bp, Homo sapiens
caaaaagggtcctgatggattggccttgcccaacaactactgtgacttctgcctgggggactcaaagattaacaagaagacgggacaacccgaggagctggtgtcctgttctgactgtggccgctcaggtactgcttcccgtgaaggctgctgctttgcccagtccccaaggggctcttggcttgctggcctctagggctgtcataaccagcccacctcgcttttcctaaccaagagaagatgtagccacaggcaggagctcctct

SEQ ID NO: 323723 - DNA, 950 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaagttacaagaacgacaggctcagtacatatgccatccattggtgagagaggggagacagagatttaacaccatctgttccaaagttgagggcgaatcaaaaggtctgatgatggtgccaaatatggattgggggataaagtaaaaaggaacgggatggttgttgagggcgaaggacaatggtcataccgagagggtaaatggggaggaggattggcaaaaagttggaaaggaaatgaacatcaaaaataga

SEQ ID NO: 323724 - DNA, 845 bp, Homo sapiens
ttatgggccccctgaagtatccttttttctagaacattctgaaagtcatccttgcctatgggaagcctaggccggcctgcactgttatgttcaataaataagcagggtgctctgggctggggattgtgtgaggagcagagcgcagcccgtcctcatgcttttccactgaagtaggccaggcagagagggagtacagcaatggatgcgctttggcagctgagtagtccgagagccagaaaagaaatgtggaaaataagaacgctgtagcaggcctaggtgaggaaatttaggaagggtttgcgggaggtaggatttgagatgggtcttggagagttggacagtgtcagccggtaggacgggggtgcggacggaagcctgtgaggaaggcagaggatgcggagctgtgagcggagggagcagcgaggctggagagcagctgggctgcgggtcaagacgtctgcgtttaattcgggactgaaggttagcagggaagggaacgatgccagatcttgagtttaagaacttgaatcttgtaaagtaccaaatctaataaaatactcgtcctaaatcattactggcccaagcatgcagtgtttccgtggccgacagactcgagccagcgctgtccatggtaaccagcttttgtgtggcttaaagcttgcatccattttctcctttcatcgttttcccaaaacaattccgtgagggctgttagccctgcttggtagacgaagaagccgatgcggtctagggtcacggccagggaggctttgggacgccaagtcagctcggcggtcaccacaccacctacagggctcgtcgggccctcggggtcggcggctgct

SEQ ID NO: 323725 - DNA, 3148 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaacaggaccagaagtttatataaatataattaataagcaaactaatgacatcaccatgggacacacacaaaagttcttgcaggagcagggtctgtgtggcttcagttgcctgcagcgctcccaggccagagcaagtgctctaggatctgaactgcccgcagtgcagccctgcagcctttcccagggcacgttgatgtgcacacagtttccctgaaggcaaagtgaacatgtggagagcttacgtggcagcgcgtatgtcttcagtgtgtgttttagaagtccaactgttgtttttatgtttttaaaggaaagat

SEQ ID NO: 323726 - DNA, 2337 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcaggaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacaga

SEQ ID NO: 323727 - DNA, 3094 bp, Homo sapiens
ctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctcctgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaacaggaccagaagtttatataaatataattaataagcaaactaatgacatcaccatgggacacacacaaaagttcttgcaggagcagggtctgtgtggcttcagttgcctgcagcgctcccaggccagagcaagtgctctaggatctgaactgcccgcagtgcagccctgcagcctttcccagggcacgttgatgtgcacacagtttccctgaaggcaaagtgaacatgtggagagcttacgtggcagcgcgtatgtcttcagtgtgtgttttagaagtccaactgttgtttttatgtttttaaaggaaagat

SEQ ID NO: 323728 - DNA, 1382 bp, Homo sapiens
gaaaacctccccgcaacccaaggagccatgggtacaaaaggcccccacattttctgtttcaccccccccacccctgagcccggggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacaga

SEQ ID NO: 323729 - DNA, 143 bp, Homo sapiens
aacatacacgcctgatttctatcttccctgcagccttggggagcagtactacaaagatgccatggagcagtgccacaattacaatgctcgcctctgtgctgagcgcagcgtgcgcctgcctttcttggactcacagaccggag

SEQ ID NO: 323730 - DNA, 1882 bp, Homo sapiens
taggctagtagaggcggggttaatcggcgaggcgtcgggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323731 - DNA, 1872 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctaaaccatttacccaaataaagtataggcgatagaaattgaaacctggcgcaatagatatagtaccgcaagggaaagatgaaaaattataaccaagcataatatagcaaggactaacccctg

SEQ ID NO: 323732 - DNA, 2110 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattcaaacaccaaccacactaaaaaaaattggtggcggcccgcccccggaaaaattttaaccactttgttgggcggggggcccacttggtacgaactggcctacgcgggcaaggaacccggccgaaagggggttccccaaaaacggggaccggtgtaccccaggtcggctcgggccccggcactacccgcccgcg

SEQ ID NO: 323733 - DNA, 1997 bp, Homo sapiens
  misc_feature (1870)..(1870): n is a, c, g, or t
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtgcattnttttctccttaactctttggggtgtatgctctaccttttcactttatatatagtttcttttagttgtttattgtcttattttaaaaattatttatttgagtgaagtatttatctctttatcatctct

SEQ ID NO: 323734 - DNA, 2369 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggtgagccaatcaggagaagctctttccactacctgcttgcaagagtgccagccaagtgagccagcctagaggggaacactggaaagagtcaggaatcctgggcttcggtgccagctctgccaatcactagctttattacctgtttctttatctattaaatgaggccaaggacccaagacctgcccacctcaccagggtatcagatgaagccctgatgagaagtcctttgcaaccgtgaaggaaactccaaatagcaccaagaggactcagaacacatggtttgacaacctaggactagaaggagactccagagaggcatagagactctaaaatcctagcactttcttggtatagacagttacccaggtactgctcagctgggtccagggaaggtcctgggtttggggctgagtccaggtgatgtgtgtcccctgcctccatttctataggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323735 - DNA, 1730 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323736 - DNA, 2223 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccaggtaaccattcccagccctactccagtctgtaacctgtccctcccatctctgtttgttttctgttttgcttgaagaatttggtccaggccctcagctcatgggaatctgcctctcactggtcctcactgggtttatcccagtgaccaattctaggatgaccagaagaatgattccactgggcttgggagtgtttgctggtacctctaatctctgtgtagagttcatggtacctgtgtgctctgtggctaggtcctcagagtcagtccctgggcaggtactgtcagccttcagttttccccacagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323737 - DNA, 1767 bp, Homo sapiens
ggaaactggagtgtgagctcctgatgcatggaagggcctgggcttgaacatcaaccagcaaggagcaggcttccatgtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323738 - DNA, 1888 bp, Homo sapiens
tcccatgagctgagggcctggaccaaattcttcaagccaaacagtaaacatacagagatgggagggacaggttacagactggagtagggctgggaatggttaccttggcaatgccctcttttaggacttgcttgaggttgcctactagtgagtggtagagctaggatttgaacccaggtctagagttggattcttagccactgttctctaccacattggggcggacattcaagttttggccagtagactcagagaggattcaggagtcaatgactgaggatgggactccttgaaattttaggtccaattaagcctgcaaaatgttctctgtttcttcctccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323739 - DNA, 1010 bp, Homo sapiens
tgccctctccagcagtagacgtgcttcccaattctgtagactgtactgacgaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323740 - DNA, 1804 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtacatggtgccggagtaaccgggatactctagaatcagccagggaca

SEQ ID NO: 323741 - DNA, 757 bp, Homo sapiens
ggaggaggtaggcagagggtccagggtgactggccagtttcattgcaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323742 - DNA, 1406 bp, Homo sapiens
ggtttgttgggagtgtcatccagatagtagcatcctgcctgaaggaatttgtggctgttctccctcctgctcttcctctgatgctgctctgcataaccagctggacctaagcttcttgcctctttagcctttaaacttttgataactgctttctgcctcctgccagggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggtgagccaatcaggagaagctctttccactacctgcttgcaagagtgccagccaagtgagccagcctagaggggaacactggaaagagtcaggaatcctgggcttcggtgccagctctgccaatcactagctttattacctgtttctttatctattaaatgaggccaaggacccaagacctgcccacctcaccagggtatcagatgaagccctgatgagaagtcctttgcaaccgtgaaggaaactccaaatagcaccaagaggactcagaacacatggtttgacaacctaggactagaaggagactccagagaggcatagagactctaaaatcctagcactttcttggtatagacagttacccaggtactgctcagctgggtccagggaaggtcctgggtttggggctgagtccaggtgatgtgtgtcccctgcctccatttctataggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323743 - DNA, 493 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccaaatcaaaatctctccactttcagctgtcttttggaggacgtacgtaataaggttttaatttagtaaaccaatcctatgcatggttttacactagcgcctgtttgtggagtagc

SEQ ID NO: 323744 - DNA, 1920 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323745 - DNA, 1853 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323746 - DNA, 1956 bp, Homo sapiens
ccgccgaccccgatggtcccctcccctccttcccaaggtccatccgccagggtgcagccgacgcactcctaatgctaaggccgccctctcatcgaccgccccttcctggcctcgactcagcgccaaaggtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323747 - DNA, 1880 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323748 - DNA, 1866 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323749 - DNA, 1382 bp, Homo sapiens
cggacgcgtgggtccggacgcgtgggtcgctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323750 - DNA, 1834 bp, Homo sapiens
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattca

SEQ ID NO: 323751 - DNA, 1598 bp, Homo sapiens
  misc_feature (1536)..(1536): n is a, c, g, or t
  misc_feature (1552)..(1553): n is a, c, g, or t
  misc_feature (1558)..(1559): n is a, c, g, or t
aagcgcagctgggtcgcatcgaggccccgccccctgagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcctaaaagagggcattgcccagactgtgttcctgggcctgaatcgctcagactacatgttccagcgcagcgcagatggctccccagccctgaaacagatcgaaatcaacaccatctctgccagctttgggggcctggcctcccggaccccagctgtgcaccgacatgttctcagtgtcctgagtaagaccaaagaagctggcaagatcctctctaataatcccagcaagggactggccctgggaattgccaaagcctgggagctctacggctcacccaatgctctggtgctactgattgctcaagagaaggaaagaaacatatttgaccagcgtgccatagagaatgagctactggccaggaacatccatgtgatccgacgaacatttgaagatatctctgaaaaggggtctctggaccaagaccgaaggctgtttgtggatggccaggaaattgctgtggtttacttccgggatggctacatgcctcgtcagtacagtctacagaattgggaagcacgtctactgctggagaggtcacatgctgccaagtgcccagacattgccacccagctggctgggactaagaaggtgcagcaggagctaagcaggccgggcatgctggagatgttgctccctggccagcctgaggctgtggcccgcctccgcgccacctttgctggcctctactcactggatgtgggtgaagaaggggaccaggccatcgccgaggcccttgctgcccctagccggtttgtgctaaagccccagagagagggtggaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccnccggcccgggcctctnncccgnnttggctccctcctgcctctggggttccctagccccagtt

SEQ ID NO: 323752 - DNA, 2130 bp, Homo sapiens
tctcttcctgacctccatcattaccaacctggtcccagccaaaatgtcccttctctggatgaccgaggatttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccatt

SEQ ID NO: 323753 - DNA, 596 bp, Homo sapiens
  misc_feature (135)..(135): n is a, c, g, or t
  misc_feature (152)..(152): n is a, c, g, or t
taaaaacaaaagtcatctagaaatatactttcaaaaagcagctacacctctagggttgaggaacaaaaggaaaaatatgaagtaaccagaacttagaagcccagaattgcaccacaatctttgtggaaggtaganccatctggcctcgtgcngaattcggcacgagaggcgatctgcccgccttggcctcccaaagtactgggattacaggcgtgagcaactgctcctggcccaaaacatctctttctacatacaccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgc

SEQ ID NO: 323754 - DNA, 2807 bp, Homo sapiens
gcctggctaatttttgtatttttattggagacggtgtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactccttttattccagcactggggtggccaaagtgggcagattgcttgcgctctggagctcgagaccagcctgggcaacatggtgagaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtggctgggactacaggcgtgcaccaccacacctggctaattttgtatttttggtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgc

SEQ ID NO: 323755 - DNA, 2382 bp, Homo sapiens
gcctggctaatttttgtatttttattggagacggtgtttcaccgtcttagccaggatggtcttgatctcctgacctcgtgatctgcccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactccttttattccagcactggggtggccaaagtgggcagattgcttgcgctctggagctcgagaccagcctgggcaacatggtgagaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtggctgggactacaggcgtgcaccaccacacctggctaattttgtatttttggtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgc

SEQ ID NO: 323756 - DNA, 2519 bp, Homo sapiens
gcctggctaatttttgtatttttattggagacggtgtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgattacaggcgtgacaactgctcctggcccaaaacatctctttctacatacacttgagtaggtggcataaaatgcactgtcaatatatagaaaacatgaaattttccaaatatttccgatcagagaatcacaagagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactccttttattccagcactggggtggccaaagtgggcagattgcttgcgctctggagctcgagaccagcctgggcaacatggtgagaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtggctgggactacaggcgtgcaccaccacacctggctaattttgtatttttggtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgc

SEQ ID NO: 323757 - DNA, 2934 bp, Homo sapiens
gcctggctaatttttgtatttttattggagacggtgtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactccttttattccagcactggggtggccaaagtgggcagattgcttgcgctctggagctcgagaccagcctgggcaacatggtgagaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtggctgggactacaggcgtgcaccaccacacctggctaattttgtatttttggtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcaaaaaaaaaaaagacaacaaaaaccacaaagaagaaaaacaagaacacaagaaacacaaaaaaacgcgggtgttttctggctgggggcgcaaggggatagcaggcacgcgcacgggccacacccttg

SEQ ID NO: 323758 - DNA, 2157 bp, Homo sapiens
gcctggctaatttttgtatttttattggagacggtgtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactccttttattccagcactggggtggccaaagtgggcagattgcttgcgctctggagctcgagaccagcctgggcaacatggtgagaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacataatataccatactcatacctaaaaaagtgggtacgtgtgggtgacctgatatcgatctgcaggcc

SEQ ID NO: 323759 - DNA, 1680 bp, Homo sapiens
gcctggctaatttttgtatttttattggagacggtgtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactccttttattccagcactggggtggccaaagtgggcagattgcttgcgctgctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgc

SEQ ID NO: 323760 - DNA, 760 bp, Homo sapiens
gcctggctaatttttgtatttttattggagacggtgtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataataacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgc

SEQ ID NO: 323761 - DNA, 2984 bp, Homo sapiens
actgggaatagaagagaaaggagcttcctttccctttccttctttcattcattcattcattttgagaagaagtcctgctctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaggtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccatt

SEQ ID NO: 323762 - DNA, 850 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggaccgccagggcaggcgggtcagtggaacactgagactgtggcagtgaaggatgggggttgaggctccaagatgcaaaatgttcattt

SEQ ID NO: 323763 - DNA, 984 bp, Homo sapiens
cccccgtctctctgggctctgtgtctaaggagccctagggcactgggtgtgagtcacttaggtgggcctgtgtggaggggtgtctggggaggacattgaacaggctgggctgaaagggcgttcggctgtcgggggaggtctctgggaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggaggagtgtggaggaagcgggctcctcagctgggggcctcggggtaggaaaggcctgggcccatcctgcccttgtggcccccggctgcagcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggactgctgctgctgaccgccttgataggctacaccgtgaagaatgcgtggaagaacaacgtcttcttctcttggtcctatttttctgggtggctggccttacccttctcaattctcgcgggcttctgctttctgctggcagacatgatcatgcagagcaccgacgccatcagtggattccccgtgtgtctgtgactgcagcctgcctggggcagaataaaggaacggctttttttaaaaatgc

SEQ ID NO: 323764 - DNA, 1498 bp, Homo sapiens
cccccgtctctctgggctctgtgtctaaggagccctagggcactgggtgtgagtcacttaggtgggcctgtgtggaggggtgtctggggaggacattgaacaggctgggctgaaagggcgttcggctgtcgggggaggtctctgggaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggaggagtgtggaggaagcgggctcctcagctgggggcctcggggtaggaaaggcctgggcccatcctgcccttgtggcccccggctgcagcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcgatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323765 - DNA, 1186 bp, Homo sapiens
ccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323766 - DNA, 677 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323767 - DNA, 666 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcatctcccagtgactagggacagtgaatggcggtatggctggcgcgcgggaggggcggacagtaggcgagactgcatagacaaaagatgggtaactacggggcgctccagttggtagggaccggacggcgtagtggcatggtgtacac

SEQ ID NO: 323768 - DNA, 1225 bp, Homo sapiens
cccccgtctctctgggctctgtgtctaaggagccctagggcactgggtgtgagtcacttaggtgggcctgtgtggaggggtgtctggggaggacattgaacaggctgggctgaaagggcgttcggctgtcgggggaggtctctgggaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggaggagtgtggaggaagcgggctcctcagctgggggcctcggggtaggaaaggcctgggcccatcctgcccttgtggcccccggctgcagcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggactgctgctgctgaccgccttgataggctacaccgtgaagaatgcgtggaagaacaacgtcttcttctcttggtcctatttttctgggtggctggccttacccttctcaattctcgcgggtaaactggacagcgggaagagggtggaggagactgcccagaagaccctcaccccagaggctccccagctgccctcccaggaaaccccggggacctctcggggactccccaacacactaacgactcccgcagacccggcagagacccccttggagccccaaaccccagtccccggggccctcccggccatccgccccagggcccaccttcctctccctgctccgcacccccgtccccccaggcttctgctttctgctggcagacatgatcatgcagagcaccgacgccatcagtggattccccgtgtgtctgtgactgcagcctgcctggggcagaataaaggaacggctttttttaaaaatgc

SEQ ID NO: 323769 - DNA, 350 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcgtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323770 - DNA, 892 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323771 - DNA, 956 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctccgttacaaaaaaaacaacaaaaaacaccgggactacaattcgggggcgaaaaaacggtaggaca

SEQ ID NO: 323772 - DNA, 835 bp, Homo sapiens
ggggggcgggggtggtggggcttctggactgagccgctgagggtgcgggctgaccctgtaagtggctgcggcgggaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323773 - DNA, 815 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctc

SEQ ID NO: 323774 - DNA, 514 bp, Homo sapiens
ggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtggccaagctgaaggagattgggcggatttgagcccctcccagagatggcaataaaactgactctcaacatctatctc

SEQ ID NO: 323775 - DNA, 1070 bp, Homo sapiens
cccccgtctctctgggctctgtgtctaaggagccctagggcactgggtgtgagtcacttaggtgggcctgtgtggaggggtgtctggggaggacattgaacaggctgggctgaaagggcgttcggctgtcgggggaggtctctgggaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggaggagtgtggaggaagcgggctcctcagctgggggcctcggggtaggaaaggcctgggcccatcctgcccttgtggcccccggctgcagcctcagtggcatgggggtgaagcggagcctccagagtgggggcattctgctcagcctcgtggccaacgtcctcatggtgctctccacggccaccaactactggacccgccaacaagagggccacagtggcctgtggcaggaatgcaaccacggcatctgctccagcatcccctgccagaccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggtgagactgcagaccgccccagaggctccccagctgccctcccaggaaaccccggggacctctcggggactccccaacacactaacgactcccgcagacccggcagagacccccttggagccccaaaccccagtccccggggccctcccggccatccgccccagggcccaccttcctctccctgctccgcacccccgtccccccaggcttctgctttctgctggcagacatgatcatgcagagcaccgacgccatcagtggattccccgtgtgtctgtgactgcagcctgcctggggcagaataaaggaacggctttttttaaaaatgc

SEQ ID NO: 323776 - DNA, 704 bp, Homo sapiens
cgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggtgagactgcagaccgccccaggcgggcaggcaggggcgggccctgggtgatggaggggcctggtcgccaggggaggggcttgaggtactcggccaggatccgaggggcagggctggaagaagccgagagaggtgggcggggctcgagacagagttcagagcgggaggagcaggaaggggcctgggccaggggcgggctgagaggcgataggcgtggtctgatagaagggggcgggtctgaaggggcgtggcctgggtgcagcccccaccaggcccagctagctcatcttgcggctgggcggggcccaggactgctgctgctgaccgccttgataggctacaccgtgaagaatgcgtggaagaacaacgtcttcttctcttggtcctatttttctgggtggctggccttacccttctcaattctcgcgggtaaactggacagcgggaagagggtggaggagactgcccagaagaccctcaccccagaggctccccagctgccctcccaggaaaccccggggacctctcggggactccccaacacactaacgactcccgcagacccg

SEQ ID NO: 323777 - DNA, 451 bp, Homo sapiens
caataagaaaaagacatcacccacaagcaaaatggcagtgctagaccattcacagcaaatcactgaccaaactgcaaatgtccaacaaaatgagtggagtacaaacctgaacctgcacgccacttcagagggcacatgtccatatccagaaaggcgaaaatgaccggcaattctattcctaacttgttccctagagaaatccttagcataaagacaaaaggatattatttacaacattgtttatagtattgcattattgaaaatgacccaaatcctcaccaacagaagaatgaataactaagttatagtatattcatggaatataattctataccccttgaaaatacatgaactagagctgtatcagcaaggaaaaatatctcaagaacaatgctaagaaaaaaaaacatgctggctgggcatggtggctcacacctgtaatcccagcact

SEQ ID NO: 323778 - DNA, 1419 bp, Homo sapiens
gggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatga

SEQ ID NO: 323779 - DNA, 1225 bp, Homo sapiens
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaagcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatga

SEQ ID NO: 323780 - DNA, 1534 bp, Homo sapiens
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcat

SEQ ID NO: 323781 - DNA, 549 bp, Homo sapiens
ggcatcaggaaccgcagggaaccaagcagcctttggtccagtgctgctccttggaacagttgagtgtggcctcaaaccattctcctgggtagctcagtcataaaacccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttcttttttttttttggagacagaaggttgcagtgagtggtggtcgcaccactgcactccagcctggtgacaaagtaagactccatctc

SEQ ID NO: 323782 - DNA, 409 bp, Homo sapiens
cagttctttgtaaagtttttataaatgttctgaatgtgtgaaggaaattaatttccaatgcacaaatatatatatatatttgtgtatatatttaaatatatatatttaaaaattccgactgagcacctgtaatcctagcactttggaaggctgaggcaggaggattgcttgaggccaggattttgtgacaagaccagcctgggcagcagtaagcccctgtctctgtttgttgttgttgttgttgttgttgttttgagacagagtctcactctctcacccaggctggagtgcagcagcacgatctcggctcactgcaacctccaactcccaagttcaagcgattctcctgcctcagcctctcggaccctgtctctatttttttttaaataaagaaataaaaattctgtgt

SEQ ID NO: 323783 - DNA, 3920 bp, Homo sapiens
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttcttttttttttttggagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaatttataaagaaaagaggtttaattggctca

SEQ ID NO: 323784 - DNA, 3920 bp, Homo sapiens
  misc_feature (3894)..(3894): n is a, c, g, or t
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttcttttttttttttggagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaataanaaaaaaaaaaaaaaaaaatttttggg

SEQ ID NO: 323785 - DNA, 1800 bp, Homo sapiens
gggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaaaaaaaatgttacagcatagagattatactgtactttttgtgtgttaaaaataagttctttatttgtttgcaaacagccacaatttttttttcttttttttttttttgagatggagtctttttttttattgatcattcttgggtgtttctcgcagagggggatttggcagggtcataggacaatagtggagggaaggtcagcagataaacaagtgaacaaaggtctctggttttccgaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaa

SEQ ID NO: 323786 - DNA, 3284 bp, Homo sapiens
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttcttttttttttttggagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaatttataaagaaaagaggtttaattggctca

SEQ ID NO: 323787 - DNA, 947 bp, Homo sapiens
  misc_feature (39)..(39): n is a, c, g, or t
  misc_feature (66)..(66): n is a, c, g, or t
  misc_feature (68)..(68): n is a, c, g, or t
  misc_feature (70)..(70): n is a, c, g, or t
  misc_feature (73)..(74): n is a, c, g, or t
  misc_feature (76)..(76): n is a, c, g, or t
  misc_feature (78)..(79): n is a, c, g, or t
  misc_feature (83)..(85): n is a, c, g, or t
  misc_feature (87)..(87): n is a, c, g, or t
  misc_feature (92)..(93): n is a, c, g, or t
  misc_feature (98)..(98): n is a, c, g, or t
  misc_feature (101)..(101): n is a, c, g, or t
  misc_feature (116)..(117): n is a, c, g, or t
  misc_feature (123)..(123): n is a, c, g, or t
  misc_feature (125)..(125): n is a, c, g, or t
  misc_feature (139)..(139): n is a, c, g, or t
  misc_feature (147)..(147): n is a, c, g, or t
  misc_feature (151)..(151): n is a, c, g, or t
  misc_feature (175)..(175): n is a, c, g, or t
  misc_feature (177)..(177): n is a, c, g, or t
  misc_feature (180)..(180): n is a, c, g, or t
  misc_feature (182)..(182): n is a, c, g, or t
  misc_feature (192)..(192): n is a, c, g, or t
  misc_feature (199)..(199): n is a, c, g, or t
  misc_feature (202)..(202): n is a, c, g, or t
  misc_feature (204)..(204): n is a, c, g, or t
  misc_feature (207)..(208): n is a, c, g, or t
  misc_feature (210)..(210): n is a, c, g, or t
  misc_feature (212)..(213): n is a, c, g, or t
  misc_feature (215)..(215): n is a, c, g, or t
  misc_feature (217)..(217): n is a, c, g, or t
  misc_feature (225)..(226): n is a, c, g, or t
  misc_feature (236)..(236): n is a, c, g, or t
  misc_feature (241)..(241): n is a, c, g, or t
  misc_feature (243)..(244): n is a, c, g, or t
  misc_feature (262)..(262): n is a, c, g, or t
gggccaaggtactgggcggtgacggtaaacaagcgtgangagtcgacgcgtagggtgcgaatcatnantntgnngngnngatnnnanttatnnggtgnganggtaggatggggatnngagtgngngaattagggaaagnggggaaangagnttaagtgcgaagggtagggtaaananaangnaaaaaattcnccctacnttntncanntntnntngnaggagggnnatttaaatanttgananngaggaaaggaagtggagnataaaaatgagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaaaaaaaatgttacagcatagagattatactgtactttttgtgtgttaaaaataagttctttatttgtttgcaaacagccacaatttttttttcttttttttttttttgagatggagtctttttttttattgatcattcttgggtgtttctcgcagagggggatttggcagggtcataggacaatagtggagggaaggtcagcagataaacaagtgaacaaaggtctctggttttccgaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaa

SEQ ID NO: 323788 - DNA, 453 bp, Homo sapiens
tggcactgctggcatgcccctcaggaaccagggaatcagggacaggcagtggtgactgtgcctatgaactatagggggccctgcagaggtcaggggctggcatgtttggtcgctgtggccatgctctcctggcccccagccccagtgcagccctgttctcatctgggtccctccttccccacaggggacctgttgatcatcatggcccagatcatcgttgccatccagatggtgctagaggagaagttcgtctacaaacacaatgtgcacccactgcgggcagttggcactgagggtgtgtgtgggcacaggggcctggaaggagtggggtagaagggagcctggggagctgagcacaggacaaggtgccagggttcacttgtggggggtgaacttcctgccccgccttgccttccagatgtgttttgacaagtcttctgacacctgctgtgt

SEQ ID NO: 323789 - DNA, 1341 bp, Homo sapiens
gggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatga

SEQ ID NO: 323790 - DNA, 854 bp, Homo sapiens
gggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagctggagtgcagcagcacgatctcggctcactgcaacctccaactcccaagttcaagcgattctcctgcctcagcctctcggaccctgtctctatttttttttaaataaagaaataaaaattctgtgt

SEQ ID NO: 323791 - DNA, 3748 bp, Homo sapiens
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccagctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttcttttttttttttggagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaatttataaagaaaagaggtttaattggctca

SEQ ID NO: 323792 - DNA, 3849 bp, Homo sapiens
  misc_feature (3823)..(3823): n is a, c, g, or t
ggcccggaagcgctcgcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttcttttttttttttggagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaaanaaaaaaaaaaaaaaaaaatttttggg

SEQ ID NO: 323793 - DNA, 425 bp, Homo sapiens
  misc_feature (399)..(399): n is a, c, g, or t
tcgatacccagctgagtccatctcaatattcaatcctcgactgcgctaccactaaaatagctactaaggaaaaggaagactataaacaagataaagaccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaataanaaaaaaaaaaaaaaaaaatttttggg

SEQ ID NO: 323794 - DNA, 227 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggactgaagggactcctgaatgtccgcgggacgtgtcgcggcggcgcccagcacggaggaggcaggcagggagggattcccacccagtgccacgtgagaacacagg

SEQ ID NO: 323795 - DNA, 1482 bp, Homo sapiens
ggagggctcccgggacagccctcggagaaactgcatcatcctcactaatgatccacttcctcctcagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323796 - DNA, 1609 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggactgaagggactcctgaatgtccgcgggacgtgtcgcggcggcgcccagcacggaggaggcaggcagggagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323797 - DNA, 1476 bp, Homo sapiens
gcctcgcaggctcagcatacatgtctgcagcaacaccatcaggtacagagccgaggcccagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323798 - DNA, 1576 bp, Homo sapiens
acctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttgatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323799 - DNA, 1167 bp, Homo sapiens
gcgccgggagcattcagtgtctcccttatcctgacttggtgggaggatcggcatagccactgaccccagggaagaggcctgccctatctgtttgctacaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323800 - DNA, 988 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggctgggaatgggggggaccaagcacttcgcagggtgacccggggagatctgtgagccagtggcctcagcgttgaatgagagctctctcccgggtccgcgctcgcagggactgaagggactcctgaatgtccgcgggacgtgtcgcggcggcgcccagcacggaggaggcaggcagggagggaataaaggctcagggaccggcagttctactctggagcccaccagcctctcagagcctccggtgactggcctgtgtctccccctggatggacatgtggacggcgctgctcatcctgcaagccttgttgctaccctcctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323801 - DNA, 818 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggactgaagggactcctgaatgtccgcgggacgtgtcgcggcggcgcccagcacggaggaggcaggcagggagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323802 - DNA, 1536 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323803 - DNA, 1716 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggctgggaatgggggggaccaagcacttcgcagggtgacccggggagatctgtgagccagtggcctcagcgttgaatgagagctctctcccgggtccgcgctcgcagggactgaagggactcctgaatgtccgcgggacgtgtcgcggcggcgcccagcacggaggaggcaggcagggagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323804 - DNA, 1702 bp, Homo sapiens
ccctgagccctcgagcagggcggatcggccgctgcctgcttaaagctggggccgccaggagtgcgatcgcctgcggatctgcagctgggcaccggccgcaacgcccgccccgcgacggcagggaataaaggctcagggaccggcagttctactctggagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaaaaaaaaaaccccaacaacagcaaaaataaaacaacccagaaaaatagacacaggcgggggcggcaggaacccggaatgacatcgcgcgcgagagagggccggcacagcgccctcccatgtggcgccagcggggcggacgatgtgcgagccaggatcgcccgccggg

SEQ ID NO: 323805 - DNA, 1473 bp, Homo sapiens
  misc_feature (14)..(14): n is a, c, g, or t
  misc_feature (26)..(26): n is a, c, g, or t
  misc_feature (28)..(28): n is a, c, g, or t
  misc_feature (38)..(38): n is a, c, g, or t
  misc_feature (40)..(40): n is a, c, g, or t
  misc_feature (45)..(45): n is a, c, g, or t
  misc_feature (57)..(57): n is a, c, g, or t
  misc_feature (59)..(59): n is a, c, g, or t
aggaccaattttantagtgtaacacnanatgaaaccangncgtgngttttaaaaaananagccggtgtcgtcgaatctggataagtcaggacgcagtctactctgagccacagctctcagactcggtgactgctgtgtctccctgatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggagacctttgaggacgtattctctgaccgctcccttcgcaaagtgccctggtacgtgctagccggaaaccatgaccaccttggcaatgtctctgcccagattgcatactctaagatctccaagcgctggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaa

SEQ ID NO: 323806 - DNA, 148 bp, Homo sapiens
tttgtacatgtgatattttattcatagaatccataaatggaagggaaatttctgagttcagagcaatacatatgatacaaaacttgatatatagactagagtttcttagccgaactggaggggctggcttaggtaatccatggattcc

SEQ ID NO: 323807 - DNA, 894 bp, Homo sapiens
ggagacgagatagagaactactctggacatactgtcataagtttgtggacgcagcttgtcttgagcagcgatacatatgcgaagtcacgtgaaacatgcggggacatcagtccctgtgcggtggagcgagcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatccctggcagccctggagaaggatgaaggaaggcgctggaggcagcaggattgcagacgcaaagctggagcagggtcggaggaaacgaaaggacctaaaacaagtagaaccccagaatgtgatcaatccaagcaatgaagacagcgataagggaacagtggagcaacagaccaggggacaaaccataaacccatgcatggtgaaatgcacggaggtagcacagagcagccgaaacaacacaagcaagacccctccacgacataaccggacaaaaccgacatcagagtagaagctagactagcaacaagaaac

SEQ ID NO: 323808 - DNA, 440 bp, Homo sapiens
  misc_feature (13)..(13): n is a, c, g, or t
  misc_feature (43)..(43): n is a, c, g, or t
  misc_feature (48)..(48): n is a, c, g, or t
  misc_feature (53)..(53): n is a, c, g, or t
  misc_feature (55)..(55): n is a, c, g, or t
ccatcacagagcnctagccgcccccgggcctttacacatttcnccaantgccncncattgctctctcactgttgttaggggtccactaattcctcctcttcctcttcctcctcctcaggatctccggattcggtaagcatcttttgctcgtcctccagtcccatgtctggctacggttctagattcaacacgagcagcaacagcggcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323809 - DNA, 9205 bp, Homo sapiens
  misc_feature (72)..(72): n is a, c, g, or t
  misc_feature (98)..(98): n is a, c, g, or t
  misc_feature (264)..(264): n is a, c, g, or t
  misc_feature (354)..(354): n is a, c, g, or t
  misc_feature (847)..(847): n is a, c, g, or t
  misc_feature (952)..(952): n is a, c, g, or t
  misc_feature (958)..(958): n is a, c, g, or t
  misc_feature (1154)..(1154): n is a, c, g, or t
  misc_feature (1315)..(1315): n is a, c, g, or t
  misc_feature (1444)..(1444): n is a, c, g, or t
  misc_feature (3727)..(3727): n is a, c, g, or t
gggcatgtgggctgaggcaggcttgcccagggcaggcgggggttcacagccccccttccgcaccttctcggncagcgactggggcctcacccacctantggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcantactgacaacgtcaacaagctgctgctgctggactatgccgctaaccgcctgctggcctgtggcagcgcctcccagggcatctgccagtncctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcangcgggtgtggagtaccgcctggtgcaggatgcctacctgagccggcccggccgtgccctggcccaccagctgggcctggctgaggacgaggacgtgctgttcacngtgttngcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttcngcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatnctggtggacctctcaaaccccggtggccggcctgccctggcctacgagagcgtcgtggcccaggagggcagccccatcctgcgagacctcgtcctcagccccaaccaccagtacctctacgccatgacngagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctnatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaaaaaaaaaacaaatagaagaaaaaaaccttggttgcgggcgcgcatagagccctcggaaagaggccttcagagaaacaacatccggtggagcgcacgcggggccccaggggaggtaaaggagacacaggggcacaaagaaggggtgacccaagagagaaaacccggggaaccggaaaaagggcacgggagtcccccacacgaataaaca

SEQ ID NO: 323810 - DNA, 6483 bp, Homo sapiens
  misc_feature (1213)..(1213): n is a, c, g, or t
gtaccccagcctctgcctccctcagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctnatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323811 - DNA, 3878 bp, Homo sapiens
tcgagctcggtccgtatttatgtgcgccagacctggaagagcagctgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323812 - DNA, 6830 bp, Homo sapiens
  misc_feature (72)..(72): n is a, c, g, or t
  misc_feature (98)..(98): n is a, c, g, or t
  misc_feature (264)..(264): n is a, c, g, or t
  misc_feature (354)..(354): n is a, c, g, or t
  misc_feature (847)..(847): n is a, c, g, or t
  misc_feature (952)..(952): n is a, c, g, or t
  misc_feature (958)..(958): n is a, c, g, or t
  misc_feature (1154)..(1154): n is a, c, g, or t
  misc_feature (1315)..(1315): n is a, c, g, or t
  misc_feature (1444)..(1444): n is a, c, g, or t
  misc_feature (3727)..(3727): n is a, c, g, or t
gggcatgtgggctgaggcaggcttgcccagggcaggcgggggttcacagccccccttccgcaccttctcggncagcgactggggcctcacccacctantggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcantactgacaacgtcaacaagctgctgctgctggactatgccgctaaccgcctgctggcctgtggcagcgcctcccagggcatctgccagtncctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcangcgggtgtggagtaccgcctggtgcaggatgcctacctgagccggcccggccgtgccctggcccaccagctgggcctggctgaggacgaggacgtgctgttcacngtgttngcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttcngcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatnctggtggacctctcaaaccccggtggccggcctgccctggcctacgagagcgtcgtggcccaggagggcagccccatcctgcgagacctcgtcctcagccccaaccaccagtacctctacgccatgacngagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctnatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggggagtggggagggaccgaatgcggggacagcgcggggtggagaggagagaaaaagcaaaaagaggaacaataacaaaagaagaaaatataaaaaacagaaaaaaaaaacacaaaacccctagaacacacaaaaaaatccagaaaaaaaacctgaaataaaagcccgagaattgtcttccaagggggggtgggaggggaagaggaggggggcggatgaggacgtctgattctcgctgagacagggctcggcacgcgttgaaagccccggtgcccaggtcttccctttcgcgggcttcagttcatccctcaagggattgggacccaggcgtccacgtacagggactggaggaagattagggacgcgggattataacatgggggttcattcctaccccccatcacctcccttcccctgactccccaccaagattttgcagagagaaatggcttttgtaccaggtcattctttataattaaactcacagtatct

SEQ ID NO: 323813 - DNA, 1260 bp, Homo sapiens
gtaccccagcctctgcctccctcagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgtctgtccaccgggggtgcagagctgggagagccatgccccacctgtggaccctgccccactagcacagccccagctctgaccttgcccgagactcacccctagctcagagggcgcccggctccagtgcaggccctgccgtagccttcagcctgccacctccttgagccccccga

SEQ ID NO: 323814 - DNA, 2358 bp, Homo sapiens
  misc_feature (72)..(72): n is a, c, g, or t
  misc_feature (98)..(98): n is a, c, g, or t
  misc_feature (264)..(264): n is a, c, g, or t
  misc_feature (354)..(354): n is a, c, g, or t
  misc_feature (847)..(847): n is a, c, g, or t
  misc_feature (952)..(952): n is a, c, g, or t
  misc_feature (958)..(958): n is a, c, g, or t
  misc_feature (1154)..(1154): n is a, c, g, or t
  misc_feature (1315)..(1315): n is a, c, g, or t
  misc_feature (1444)..(1444): n is a, c, g, or t
gggcatgtgggctgaggcaggcttgcccagggcaggcgggggttcacagccccccttccgcaccttctcggncagcgactggggcctcacccacctantggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcantactgacaacgtcaacaagctgctgctgctggactatgccgctaaccgcctgctggcctgtggcagcgcctcccagggcatctgccagtncctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcangcgggtgtggagtaccgcctggtgcaggatgcctacctgagccggcccggccgtgccctggcccaccagctgggcctggctgaggacgaggacgtgctgttcacngtgttngcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttcngcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatnctggtggacctctcaaaccccggtggccggcctgccctggcctacgagagcgtcgtggcccaggagggcagccccatcctgcgagacctcgtcctcagccccaaccaccagtacctctacgccatgacngagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcggtgaggtggccagggcaggggctgggggccgtgagccggaatgggccggttatcctcacggccctgggtcctggcgtgtgcttgttcataaagggcagtgcacgtgctca

SEQ ID NO: 323815 - DNA, 274 bp, Homo sapiens
aaggaagtcctgtgtaggatgagggtggagagggagcggttgtggctgcagaaacttccccctaagctggcgccctggtggctttgtgggcgtgaggcttgggaggcctggaggccgcttagctgggaagcctgacggtgccatcacctaacagtactcctacgaggggaacgatgtcagcgacctgccagtgaacctgtcagtcgtgtggaacggcaactttgtcattgacaacccacagaacatccagggtgagtgggcgccccggcggggt

SEQ ID NO: 323816 - DNA, 8997 bp, Homo sapiens
  misc_feature (72)..(72): n is a, c, g, or t
  misc_feature (98)..(98): n is a, c, g, or t
  misc_feature (264)..(264): n is a, c, g, or t
  misc_feature (354)..(354): n is a, c, g, or t
  misc_feature (847)..(847): n is a, c, g, or t
  misc_feature (952)..(952): n is a, c, g, or t
  misc_feature (958)..(958): n is a, c, g, or t
  misc_feature (1154)..(1154): n is a, c, g, or t
  misc_feature (1315)..(1315): n is a, c, g, or t
  misc_feature (1444)..(1444): n is a, c, g, or t
  misc_feature (3727)..(3727): n is a, c, g, or t
gggcatgtgggctgaggcaggcttgcccagggcaggcgggggttcacagccccccttccgcaccttctcggncagcgactggggcctcacccacctantggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcantactgacaacgtcaacaagctgctgctgctggactatgccgctaaccgcctgctggcctgtggcagcgcctcccagggcatctgccagtncctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcangcgggtgtggagtaccgcctggtgcaggatgcctacctgagccggcccggccgtgccctggcccaccagctgggcctggctgaggacgaggacgtgctgttcacngtgttngcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttcngcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatnctggtggacctctcaaaccccggtggccggcctgccctggcctacgagagcgtcgtggcccaggagggcagccccatcctgcgagacctcgtcctcagccccaaccaccagtacctctacgccatgacngagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctnatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323817 - DNA, 4625 bp, Homo sapiens
cggaaggcagggcagacccccttaggctggggctgctgtggcagattgggagggctgtggcacattgcaggggactatggcaggttaagtgtgctgcagcaggggcggaggtatgtccctgccctgtgctggtgctgagagctgcaggcaggccccgtcccactacactgctgtgatggaggagggaaagagggccccagcggccccaccctccagctccctcctcccccagagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323818 - DNA, 3759 bp, Homo sapiens
tcgcgggatgcaaattaggctaagtagaggcgcggttaatcggccgaggctccactctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323819 - DNA, 4356 bp, Homo sapiens
  misc_feature (72)..(72): n is a, c, g, or t
  misc_feature (98)..(98): n is a, c, g, or t
  misc_feature (264)..(264): n is a, c, g, or t
  misc_feature (354)..(354): n is a, c, g, or t
  misc_feature (847)..(847): n is a, c, g, or t
  misc_feature (952)..(952): n is a, c, g, or t
  misc_feature (958)..(958): n is a, c, g, or t
  misc_feature (1154)..(1154): n is a, c, g, or t
  misc_feature (1315)..(1315): n is a, c, g, or t
  misc_feature (1444)..(1444): n is a, c, g, or t
gggcatgtgggctgaggcaggcttgcccagggcaggcgggggttcacagccccccttccgcaccttctcggncagcgactggggcctcacccacctantggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcantactgacaacgtcaacaagctgctgctgctggactatgccgctaaccgcctgctggcctgtggcagcgcctcccagggcatctgccagtncctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcangcgggtgtggagtaccgcctggtgcaggatgcctacctgagccggcccggccgtgccctggcccaccagctgggcctggctgaggacgaggacgtgctgttcacngtgttngcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttcngcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatnctggtggacctctcaaaccccggtggccggcctgccctggcctacgagagcgtcgtggcccaggagggcagccccatcctgcgagacctcgtcctcagccccaaccaccagtacctctacgccatgacngagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaa

SEQ ID NO: 323820 - DNA, 559 bp, Homo sapiens
ggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaagg

SEQ ID NO: 323821 - DNA, 510 bp, Homo sapiens
ggccgcggcatccccctgcccatccagaccttcctgtggcggcaaaccagtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaagg

SEQ ID NO: 323822 - DNA, 343 bp, Homo sapiens
cggccgcggcatccccctgcccatccagaccttcctgtggcggcaaaccaggtgaggggcgcagagggcgcaccgcgggccgccctgggctgggggcgctcctggggccgcccgggtcgccgctgccgccgccgccgctgaggccgcgccacagcctgcagctccctctctggggctggaaaacaagccctctgcaccagcttaaaaacacgcattaaaatatgtatatatatgtatatatttcagtgaagtttgacgacaagcagattggcagttgtcgcataaatgtatacattattttagggggtgggagggcagagagcctgggaagagggggcgggga

SEQ ID NO: 323823 - DNA, 314 bp, Homo sapiens
gtgtgtgtgtgtgtgtgtgtgtgtgtattttttttgtctgcctggtcctttgttgctaaacatgccatttcagcagtctgctttgggtttgtgtttgagatctgttttaattgttgtggcctgttgagaaagaacacagacagactgaacacaaaacaattcagtggtgcaaaatgaggcctaatgataggatagcaatatatgtacaaacagaggttctttataattgaattgagaaaagaggtgggagagggtgtcatgtggcacacagtaatataagcatgtggatggcaagagaactacttacggagaga

SEQ ID NO: 323824 - DNA, 789 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323825 - DNA, 902 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttaaaaaaaaaaaaaacccgggctcttatgccggggggggaaaagggtatgaacggccctggccatgggttccgaccattttgtcagggaaacccggcccaagaggcaaaatcaac

SEQ ID NO: 323826 - DNA, 836 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtgaacccagggagaaaacccaatgccacctttctaagggatttcaagaggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323827 - DNA, 363 bp, Homo sapiens
gttgtccctcgtagagaagttggttgggaaagtcgagtgcgtattaatacgcactgagtttcctcctcgttcttccccctacacccaggaaatacagtttgcaatgcactgaaacagaaccgagcaagtcatgagatttgggagtaaagatgagacagatggttgaagaaaattagaggcataatttctcagtgaatcaaggaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323828 - DNA, 416 bp, Homo sapiens
gttgtccctcgtagagaagttggttgggaaagtcgagtgcgtattaatacgcactgagtttcctcctcgttcttccccctacacccaggaaatacagtttgcaatgcactgaaacagaaccgagcaagtcatgagatttgggagtaaagatgagacagatggttgaagaaaattagaggcataatttctcagtgaatcaaggaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttaaaaaaaaaagaagaaaataatatttgccctatagagagttcgtattacaagtc

SEQ ID NO: 323829 - DNA, 1094 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323830 - DNA, 1850 bp, Homo sapiens
  misc_feature (1849)..(1850): n is a, c, g, or t
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaataaaacaaaatacacacaccaacaacaaacaacaaacaaactaccaaaaaaaaaaaaaaaaaaaaaaacaaaaaaaaaaaaaaaaaaaaaaacaaaaaaaaaaaaaaaaaaaaaaaaacacaaccacaaaacaaaaaaaaaaacaaaaaaatagagggggcagcctatctgaaaacaacaagggagaccacaaagtctgacatcacacaacataaaaagagcggctctcaataagaagaaataaaacaatacagcggcgacgggcaaacaaacagacaggacgccggaaaaaaacatccccacgcacctaggagagagcaacacccttagagtagagacaaaaagaggaccaacacataccacgataataacccagccgcacaacaaacaaagaaagactgtcgagataacccaccactataactgacgacaagaaaacaatgacatagcagggtattcgccactatcacgcgcgcatcacgctaactataataaatacagaagcagtagtgcgtccagacgaaggcgtcagcgacaagggaaagagaaaccagacgagacgtggtcagcgctatagcataggaaaagagaaagaacagaccaacgaaaaggcaaaaaaagacacaaccccccagcagagagagagagaatcaaagagataagaaagcaaaaaacaaatgaaactaatcagaagaggagagaagaaaaagggtgaaactagagatacaaatcaactctccctgggtaagtctaatnn

SEQ ID NO: 323831 - DNA, 1086 bp, Homo sapiens
gcgttactcgagacctgtgcctcctgcaggaggaccaggccttgacgcggcaggacgaggatttggggctggctaacggggctgggcctgttgttttgcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323832 - DNA, 1446 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtgtaagcagcgggaggggagccgggcgatgctccctgggttcccggtgtctgggagccaccggagtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgagatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323833 - DNA, 968 bp, Homo sapiens
ggtcggagtgtggtgcaattcgcaggagggatggcagcgtctatattaccttgaagatttatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323834 - DNA, 1141 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtgaacccagggagaaaacccaatgccacctttctaagggatttcaagaggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323835 - DNA, 1181 bp, Homo sapiens
gtaagattgatacttgggttcactgctctccggagataagttttaccagtatgtttcaagtaaaagctgccagggtgtgaatttcaacgctaataccgtcttcctttctagtttttttaagttagattttgtcttaggctgtagatacatgctacctatactatagttgaacaagaagttgcctgcaattttcccttggaaaaaaacgtaaaaaatgtgtgcaactgtctgtgggtgttgcagaagctgctataatgtgaaagagtgttttatgcttataccattttccggtacaagtgtccaatggtgctatattctttcctgatttttggctaccctaaatccattatgcagatagggctggtgttctgccagtttgcacatcttcccactaaggtatgctctgttgtatctttcaggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323836 - DNA, 1212 bp, Homo sapiens
  misc_feature (115)..(115): n is a, c, g, or t
  misc_feature (130)..(130): n is a, c, g, or t
  misc_feature (134)..(134): n is a, c, g, or t
  misc_feature (137)..(137): n is a, c, g, or t
ggacacattccgtctgctcactggtaccgcggctatagtcggtgaggcagtgcgatcctcagctgtctgtcccgtagagtaggagctctggtggtgcgcatgaactgcagtgacnttgcgtgttcctcgnaccntgntacacaagaacatgtctcccgaggagagtgcctgagacgctccgtggcaaccagatctctcatgatctgaccattgcatagaaagtcattacacgtggcgatcatcatacaacccagatcacctcacaagagacagagagcttctgatgatcagaggactttacgccacccgggccatgacaaacaagtgtctgttaagagctaccgatgggaagaagaagatcagcactgtgaacccagggagaaaacccaatgccacctttctaagggatttcaagaggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323837 - DNA, 780 bp, Homo sapiens
gccgactactactactactactactactaaattcgcggccggtcgatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323838 - DNA, 1043 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323839 - DNA, 1024 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323840 - DNA, 770 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgcacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323841 - DNA, 742 bp, Homo sapiens
  misc_feature (541)..(542): n is a, c, g, or t
gagatatgaggaaattgttaaggaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttaaaaaaaaaaactnnacactttttaaaccaatttaaatagactttacgctttataccaatgatcattaaatactcattcctgatatacattacgtaaaataaaaacttcggggggggcccccgtccacaaattgacccttaagggagtcgtttacacataaggggccccgttttcacaccttgaacttggagtgcgttttgcgaaaggcccccct

SEQ ID NO: 323842 - DNA, 1009 bp, Homo sapiens
gcgttactcgagacctgtgcctcctgcaggaggaccaggccttgacgcggcaggacgaggatttggggctggctaacggggctgggcctgttgttttgcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgcacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323843 - DNA, 1501 bp, Homo sapiens
  misc_feature (1500)..(1501): n is a, c, g, or t
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttaaaaaaaaaaaaaaaaaaaaaaaacaaaaaaaaaaaaaaaaaaaaaaacaaaaaaaaaaaaaaaaaaaaaaaaacacaaccacaaaacaaaaaaaaaaacaaaaaaatagagggggcagcctatctgaaaacaacaagggagaccacaaagtctgacatcacacaacataaaaagagcggctctcaataagaagaaataaaacaatacagcggcgacgggcaaacaaacagacaggacgccggaaaaaaacatccccacgcacctaggagagagcaacacccttagagtagagacaaaaagaggaccaacacataccacgataataacccagccgcacaacaaacaaagaaagactgtcgagataacccaccactataactgacgacaagaaaacaatgacatagcagggtattcgccactatcacgcgcgcatcacgctaactataataaatacagaagcagtagtgcgtccagacgaaggcgtcagcgacaagggaaagagaaaccagacgagacgtggtcagcgctatagcataggaaaagagaaagaacagaccaacgaaaaggcaaaaaaagacacaaccccccagcagagagagagagaatcaaagagataagaaagcaaaaaacaaatgaaactaatcagaagaggagagaagaaaaagggtgaaactagagatacaaatcaactctccctgggtaagtctaatnn

SEQ ID NO: 323844 - DNA, 974 bp, Homo sapiens
  misc_feature (812)..(813): n is a, c, g, or t
  misc_feature (817)..(817): n is a, c, g, or t
  misc_feature (823)..(824): n is a, c, g, or t
  misc_feature (830)..(830): n is a, c, g, or t
  misc_feature (832)..(832): n is a, c, g, or t
  misc_feature (840)..(840): n is a, c, g, or t
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttaaaacacacaccaacaaacaaaannccgnggggcnnatatgngnggggcggnaaacaggaggctacacgacaaggggcccaggggcacatcagcgtgtgcgctgacccagcgttcttggcaacaaggggggcaacccgggcgggtccccataagagacggcataacttggatagccgggtaccgaa

SEQ ID NO: 323845 - DNA, 539 bp, Homo sapiens
aattaggctaggtacgaggctgggtttgaatcggccgaggagagaactagtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323846 - DNA, 1046 bp, Homo sapiens
  misc_feature (6)..(7): n is a, c, g, or t
gcaccnngcacttctggaaaagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323847 - DNA, 833 bp, Homo sapiens
gagatatgaggaaattgttaaggaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323848 - DNA, 1575 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtgtaagcagcgggaggggagccgggcgatgctccctgggttcccggtgtctgggagccaccggagtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgaggtgtttaacaaaactagagcagcggggctgggttaggtcatcacttaccccactcctctgttttaactgtttgtctgccgctcagccacgtacgcggccgtgttcaccaggatgcattttttccttcagatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323849 - DNA, 802 bp, Homo sapiens
ttcggacctcggctctgctgtgtctctcttcttcagatgggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaat

SEQ ID NO: 323850 - DNA, 894 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatgccaggtagacctaacgatgactctgtgactttaagtactagtttataatttgacaagaggcaaggttgaatataatgtaatgcttttagcatttagagttaaactggattgttttcattcctcagttataacatgaaatagtttcttaattgctctctcacccacacctacctgttagtctacctgg

SEQ ID NO: 323851 - DNA, 764 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323852 - DNA, 868 bp, Homo sapiens
agtagcggaagtcccgcccagcctaggccgaacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtgacgatcttgtggatgagactccaaggcaagtgaatacacgtttcagatgggcttattgcaacaccttccttagagctaacagtggagtgggttagacatgaagaagatgacgaatatagaagaactaaatagtaaagaaggacctacatatgcatggaagccaagccaagttacgcgatggagcgaggcaccatgccggcatgtcagtaacaagcaagcaaacatacctatgtaaagcttaactagacagtgatggcaagcagctagcgacaagtacaggggctagttcatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgttta

SEQ ID NO: 323853 - DNA, 2562 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323854 - DNA, 2951 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaaaaaaacaccaacacacacacaacccacccccccacacaccccacaccaccaccacccaccaacgcccacccacccacaccccacaccacaccactacacaccccgcccccacacccccaacacacacacgccgcgcggcgcccacacacgaacaaaacacccacacaccaggcaagcaccaaacaaccgaacacacatcacacctacacacaacgcccaaccaaaccgcacaccacaacaacacccacccacacgcccagccacccacaaccccaagactccgccaaaaccatgacagagtaaacacaccaacgccaccacctgcgctgcacgaaaaacaacaacaaacaacaacacacgaccaacccacgcgcgcaaccaaccgacga

SEQ ID NO: 323855 - DNA, 947 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgagtaagtttggggcgcgggtcggctccgtggagggcaggcacgccggccctggagtagaggcgaggcagaggcggcccgcaggaggcttctaggcgtcgggcctagcgaggggagcgaactctgaagcctgcgggccccggcgacacggagggcagaccaaggtcacgaccccgaggcgccctagccgaggggacggctccgacctccagacccaggcggcttgcgaccggcagggctacggggtcacttccgggctgtcccccaccatgaggtagcctcgggccggcggcctcctgaggtcctgggggcgtcgcggagcacgaagcccttgacagcactcagggttgccccatcccgccctgtgaaaccactttgggacgtggacccgaggatcccaagagggaggtgtggttttctccagagtgtactttccctggccgccgtttgggtggagtttctaccttcgaatgtgaatttcgggtgaactctgaccaccaggatgtgaagccttttcacaactcgttcatctacgcagcagagccttggatttggaattcaaggtctagctctggctgtaacaagcgtgtgaccctgggttacccattttcatctgagagatggaaaaggacgatcgtcagggcctacccgtgttagctcttgaggccacgttcaaggaacatctttttggcataatgtgactgtttactaacgaatagctgaaccagttgatgtgggaagtagatctttctatgtcctgattcattctaaaggccctaatttagcgggaaatctttttt

SEQ ID NO: 323856 - DNA, 2884 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaaaaaacaaaaacaaacaaaaaaaaaaggggggggggcaaaaaatacccccgggggcaaattagccgcgacccgttttctgtaccagcgggcctaagggaggcataaagaaggcggcgggtaaacaagcgacggaaaaagggcgttcgcctgggacggaccacatgtggggggacatatgggaccacaccagaaataagcgagaaataaactcacgatacgcagcaagcatcgcgcgaattggtgctattaatctgactataaatcaggagaaagcacaacgagcagcaagacaacaacacaacgcgaaaaagaaacgcatacg

SEQ ID NO: 323857 - DNA, 2503 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323858 - DNA, 2470 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataattcgtaatatctgtctgaaaggtggtatgctatatttaaatctatctggatttaaaatggcatgtaactataattattcaggggagtaccttaactatggaaggagataggaacggaggttaagacgggtaaagaggtgggatggattggaaaaaaaagggggcgataatgggggggagtaa

SEQ ID NO: 323859 - DNA, 2445 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttagcgatgttttatttagctgaaatgttatttcacttgtaaaaactatctccggttacaaaaaaaaaatcagaaaccttattaaatttaacctgcttttacagtcgacg

SEQ ID NO: 323860 - DNA, 2472 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323861 - DNA, 1437 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctga

SEQ ID NO: 323862 - DNA, 2508 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaattaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323863 - DNA, 2038 bp, Homo sapiens
attattatacttatagttcagtactacggtatgtattaagagtccggcctggtcgcgaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323864 - DNA, 1001 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtcgcgggaccctggaaactggggcaaggttgtcccttgcccaccccggagccgggccctaaaaaaggggtccctggatgcgtgggcgccaccacctcgcttgggggcacgtttgggaaacaacacaaaccggaacggagatacagcccaggaatccacgtccactggccccgttgccccgaaaaccctaacgctgcgccacgag

SEQ ID NO: 323865 - DNA, 1074 bp, Homo sapiens
  misc_feature (12)..(12): n is a, c, g, or t
ggggctactccntagtttagatgttgtttcagaggtttcttttgtggttctggttgtgtgttacttcggtccgatgtggaacatccctagcggtaaacgcgccatattttaacgactaatagggtactccgcaccgatgacggccatgatcgtggcgagaacgccgaatacttcgtatgcatcaatatacgagtatcagtgacgtaccgacatatgccggatcgccattacgccgggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323866 - DNA, 1363 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttgga

SEQ ID NO: 323867 - DNA, 1020 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctttctgaatgttttacttagcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtcgcgggaccctggaaactggggcaaggttgtcccttgcccaccccggagccgggccctaaaaaaggggtccctggatgcgtgggcgccaccacctcgcttgggggcacgtttgggaaacaacacaaaccggaacggagatacagcccaggaatccacgtccactggccccgttgccccgaaaaccctaacgctgcgccacgag

SEQ ID NO: 323868 - DNA, 2517 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaataaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323869 - DNA, 2532 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatgggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaa

SEQ ID NO: 323870 - DNA, 1578 bp, Homo sapiens
acagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactggttaattctttagctttttaatttgcctacttaaaaatgcatgtgtcaaatatggtttgtaatgtaagctgatagcaggtattggaatatcttttgaagatgggcgcaaaatttttttgaggggggtttttaaaccaagtgggtagggggaaaaacgcgggtgg

SEQ ID NO: 323871 - DNA, 391 bp, Homo sapiens
ggaatttaagaattggagatgatttttgaggacatttggtccaaactttacccggtgcagaagttgatcttgttatctctctgactgataagagaaacaccacctatttgcaaacctcggtggggtcaatagtacattcacccgtctttcacttcatcctcatatctgcatggcgagtttgttgttttcgttgtgctactgacatcattgctaataatgcttattgggtactttctttatgaaatccattcattaaaggaatattcatttaatgattatttacctggggcttcatgtgccaaacaatgagtgaaacagattacatgccttatcttattgaatcctacgacgagcacctgagacaggtgctgtctttatctcccatttgcag

SEQ ID NO: 323872 - DNA, 270 bp, Homo sapiens
ctttgtcacccaggctggagtgcagtggcaccatcttggctcacagcaacctccgcctcctgagttcaagtaattctcctgtctcagcctcctgagtagctgggactacaggtgtgcaccactacgcccagctaatttgtgtatttttagtagagacggggtttcaccatattggttggccaggatggtctcaatctcttgacctccggatcaactccccttggcctcccaaagtgctgggattacaggagtgagccaccgcgcccggcc

SEQ ID NO: 323873 - DNA, 1223 bp, Homo sapiens
  misc_feature (1)..(3): n is a, c, g, or t
  misc_feature (767)..(767): n is a, c, g, or t
nnnagggtttaggttattttttgtttttctcttctagaaaaatataaggaaactaaaattatctataatgctctcttgagggcaggtcttatatatgtattatcccacttcccagcatggttgtttcttaatagataagcatacaaactgatgctttgtaagggtttgaactttcaatagagagaacaatttgttaatagccagaaattttccctttcctcctttatatatgctgcatatcatctatagggtagaggaatgagaaagtatgttttataaggtaaaaatgaaaattcaaagatgaaacaacaataaaggtaaagccagagagagagacagaggagtacttcgtataaacattctgtatacattaggcagaatctaataaatgtttttgggtggatactaaaatactaatgaaacatttgcttataagagaataaatttctactttttaattgaattttagttttactggtgtaaccttctgtatcccttctgtcttattagctaaatgcattcgttattatacagtctaagttggaagtctaaaagcatatttattaaggtgaatatttcatggagatgaaattatggaagagtttagcttctttatatttttatagaaatttgtacttgtactttatcagaaaaaaaattttatacttacatgcttatgaaaactaatgtataaaatggtgaaattgattgaaaggacatttattgaaaggcatttattgaatggtatttattgaaaggacaagatntacattttatttttcccttcagctataataaccataaaactatttcctagaagtctgctagcaatttaacactaattaaggaaaaccttaacttctgccctttttttcctagatgagaatgaagatttaaggaaacttgcagagaatgaaatcactttgtgtcaaaaagaaataactcagctgaagcatcaggtatggtatttctgcaaagaataaagcatttgtgctattcttaggcattaaagtttattaaaggtttataaaaacaagtgactagcttgttactgtttagaataaactgggttttttaaatttattttctagatttattgaggtataaattgacccccaaaattgcatatatttaaggtatatgatgtgatgttttgatatatgcatacattttgaaatgattatgactatcaataaactggtttttaaagaacaaacttcaca

SEQ ID NO: 323874 - DNA, 637 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcaggtatggtatttctgcaaagaataaagcatttgtgctattcttaggcattaaagtttattaaaggtttataaaaacaagtgactagcttgttactgtttagaataaactgggttttttaaatttattttctagatttattgaggtataaattgacccccaaaattgcatatatttaaggtatatgatgtgatgttttgatatatgcatacattttgaaatgattatgactatcaataaactggtttttaaagaacaaacttcaca

SEQ ID NO: 323875 - DNA, 3850 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323876 - DNA, 3738 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323877 - DNA, 3630 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323878 - DNA, 3188 bp, Homo sapiens
taagcttatagtctctcccttttttattagagtcctctgttttttcccctcataaaggaagaagaaaaaggatgaggaggaaaagtattccttgataataagtaaagaagatttttttattaaaactttttaattctcgtaacactattcaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323879 - DNA, 3110 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323880 - DNA, 2575 bp, Homo sapiens
gccacgaacagtgctcgttcgttcgcagggccagcaaggagagccccgcccatgtctgctcatggtgacagaatcgaatagaatataacatatggtcctcattacatgtggttttcccaataaccatcatatagtgatatcgtaacgagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323881 - DNA, 597 bp, Homo sapiens
ataaaaataattctatttccctgtattttcaaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgaggtaaggcataagcccctctccttggaatcccgggcctagcacagtgccttgtccccagagttaacattcagagtttactgaattgagtatctatttggtcttccttgtgtattttgagttgcatattatctcagtctaaaaaatataattttataatgctaaaaaattaaggatttgtaaatgatacaatgttgcattgtctgtgtattagtattttcctaataagtagttattgtgagatcatctctgtgggtgaaataataacctatttaaatatggactggttgcctttataatgacttctgccttgtgtgactggtttgtggggtattaacagcaacaatcctatttaacaaaggtaattacttaacagaattgctgcttcataacccagttacat

SEQ ID NO: 323882 - DNA, 1828 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacggtaagggtcgggcccgggggagaggcgtcagagcacattcttgactcttcgtttgacttttccactgcccacactacccgagtttgaaactctttactcacttgcagccgtttttattttggatcagaggtcaggacatcattacgtgctgtgatcccatcctctcctgtgggctctcttgtgctcctttgccacggcgctctgccgccttttacatgcttattagttgtggactcgggcaagagctcattagctcagcaaggataaataaggcactgtccctgtgatgggctccacagcggtgtttctcaaagtgtggtgtggagacccatttgcagtagtatcagggcagtgcttgttaatagcagacttaggactcagaatctcagacctatacgtgggtaaaggtactaaattgggaaattcagtatggcctaagtatagaataggtgggagatgatgtcatagaaacatgaagccagaaaaatagttaagaaccttgcaagacaaagaatttggatttattttttatagaccatggaaagttagcaaatgtttttaagcagagaattcacgtctttgtaaagaaaagttaatggtggcatgcgctgaggataaattggagtattctccagaaacgctggtggctgacaggccagggaggaggcagttgaaacaatccaaagaagaaatggtgataggcatagttctgactcacaaaacattttgagaaacaagttaggatttagtggcttatgccctgagaaggatgagggagagagttagttctaagaaaagtcttaggtttctggcttcagcacgagtggtactgttaattaagatgaaagtataaaagttggaccgaattttttaaaaagatgagttttgcattgaatgccatattaagttaaaaatacctgtgaaaaggaattccaataaagatatctgtactagtctaggagaaaaaattactgacataggagaaaaattgagcccaaataatcatatgagagctctcgagatatacagtacgtggtaaattaaaccttagaagtagatgagaacactcagggaaaatgtgttaagatagaaacaagtctaacaaggccagaaatacacagtatttgaggagcaggcagagaagaaggctataaaaggtcaagaaaaaaacagccagagctttgtgaccctgaagtagataaataaatgaagctgtagaagccaatagaaaatttcaagaagtaagagatccttggccaggcgtggtggctcacgcctctaattccagcactttgagaggctcaggtgggccgatcacttgagcccaggagttcgagaccagcctgggtaacatggcaaaaccctgtctctacaaacaatgcaaaattagctgggcatggtggtgcgtgcctgtggtcccagctacttgagaggctgaggtgggagaatcgcttgaacccgggaggtggaggttgcagtgagccaagatggtgccactgcattccagcctgggtgacagcgcaagaccctgcctc

SEQ ID NO: 323883 - DNA, 3875 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323884 - DNA, 3767 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323885 - DNA, 3713 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323886 - DNA, 3232 bp, Homo sapiens
cgcatataacgttagcaacacagcagtctcctaattaatgacagcttgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagctatgatgtcctaggactgagagtaccccaggaaagaatacccttgaaagggtctccccttccccatggtgaagtcaggcctaatggagagagtggctacagcctactcagtgattgggaaattccctgtcttgccctgggccagagctggtgtaccgctggtggatcaggtcttacaagcaaagaacctcacactcccaactggtaagccagaagcctcttgctagggtgtgagcaaaacttggacaggaactctcagtagatgtttgtgtttgtcaagattctccagacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctcaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgagggattctcttaggactgggatgaaggcccataataaaagaggtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323887 - DNA, 2917 bp, Homo sapiens
  misc_feature (3)..(4): n is a, c, g, or t
  misc_feature (6)..(6): n is a, c, g, or t
ggnncnggtcagggtccgcgatctcggactaaggatgcggtcccgggttctgtggggcgctgcccggtggctctggccccgccgggccgttggcccagcccgccggcccctgagctccggtagcccgccgctggaggagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaagttgatttgttatttatagactttcgtagcttagaaaaattctacagtacatccacatagggtgaaagtacccttactctcttgaaaaacgttgagttaacacagttggaggtaatatgcatattctgaagtcatagataatttacacagatctctctcaatgcattagcaaaaatcatacaatatacagatggtcctcgatttacattgtggttaattcccaataaacccatcataagttaaaaatgcatataacgttagcaacacagcagtctcctaattaatgacagcttgacttaacaattttccaactttaccatggtgtgaaagaggtatgattcctaagccctaaggagctcctcagcttgaaatggggctgcatccctataaacccatcataaagtcaaaaaatcctaaaacataagttggtgaccatctgtaatcatgatgtggtggtaaatcttggacgctaccttacaataactagacaaaggaaaatcatcctttgtcctgttctgtgtaaatatttaatgaatgatcaaaacttcagtttaaatattatgaaaaactttaaacataaagtagtagaaataagacagtaaatactgtatcctaatatccagtcaggatacagaaaccataccattaacttgaacagggataattttaatataaaaactgttaactgataatggtattaacttttaagagggatgaaagagagtttcagggagcatcctgctagcttgccttctgtatgtgagaacacagcaagaaagccctagtcaacaagtgccagctccttgatcttagacttcccatcctccagaactgtgagaaatacatttctgttccttacaaattacccagtctcctgtattctgttatagcagcacaaaatgaagataccatacctgaacacctgaacattcttcacaaggtagtaaatgcactgctttattctggtctcagtattgtgtgcttaataaggaaatgagaaagggtggatcagggcataggatgaacaagttactgctagacctctcacaatgccactaatggataagattgtattttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctaaagcactagttaatcaaaattcattagtttttaatggtactaccactctcaaatttaaaatgtcatcttacgttcctcttcctcgcattggatttattgctaaaacctggtaaacacttttaatccttttcaattccattaccactgctcttgtccagaattacttcgcagactaatagtcacctgacttctcccctgcatccgatttgctgtctaattctggttacaaataagtaactgccaaactaatctttctaaaaagcaagactgatctcgtcactcctttgctcaacaatgtaaaagctcccattgtctcccaaataaaaccagctttccactgtgtatacaatacatccatgatctgtatccagcatcattttgtattagctcactttatacaccaccccccatgccacatcaaattaaattatcctgataaatgcaactgcatttaccctttcccttattttgttctttatgttgtaggcctcctttgtgcccatttcttcagaagacatcccc

SEQ ID NO: 323888 - DNA, 376 bp, Homo sapiens
ggttgtggggggtgggtgcatagatgaaacaaggccggctttaagttggcaactgttgaagctggatgatgggtgcataggggtttactgacaactgtctccagattagtatgtttgtaaacttccataataaaaagttgacaacaaaccaacaaacaaacatgaactctggagacagactgcctgggaatttacttaatctgtttgtgtgctgtagttttcttacccataaattggagatcattgcacctgcttcacagggttgttgtgaaaattcagtaagtcaatacacaaaaaggctggaatgatgcttggctatcgtcaccatcttatggggagaaagatggtcacagaccaccaacactcatcacccttt

SEQ ID NO: 323889 - DNA, 231 bp, Homo sapiens
atgaaatgttccaaatagataaatccacagagatagaaagtaaattagtggttgtgatgggctggggggagaggaggatggagaagcactgctagtgggtatgggttctccttttgggatgatgagaatgtttgttttctctttatttctttttcttttcttttgtagagatgggttttcgccatgttgtccaggctggtcttgaactcctgacttcaagcaattctcctg

SEQ ID NO: 323890 - DNA, 981 bp, Homo sapiens
gcagtgctatccctgtatggatggccacgtacatggcagggacattgaaggtctcaaacatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaa

SEQ ID NO: 323891 - DNA, 1415 bp, Homo sapiens
  misc_feature (1)..(2): n is a, c, g, or t
  misc_feature (5)..(5): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaa

SEQ ID NO: 323892 - DNA, 1911 bp, Homo sapiens
  misc_feature (1)..(2): n is a, c, g, or t
  misc_feature (5)..(5): n is a, c, g, or t
  misc_feature (1538)..(1538): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaaaanaaaaaaaaaaaaaaaaaaaaacaaaaaaaagaacaaaaaaaaacaaagacgaaaagcaaagacaaaagaggagggcgggccgccgcgcggcccacagaacgggggacgaacgacacaacctcgggggggggggcgcgccgcgcgcgagcgtcacgacgcgtgagatgcccgtctctcacaccgcgccgcgggccgccccaccacccccagtgcgggatgcgctgtcacacggcagcacaaacacgctccgggcggccagcacacgcttgggtggtcgtagcacaccaaccaaactcgaggtgctcagcgaacctgacggacgccctaatcgcagcaggggggaccctccaaggtcgcgcccgactgatcccgc

SEQ ID NO: 323893 - DNA, 1278 bp, Homo sapiens
  misc_feature (1)..(2): n is a, c, g, or t
  misc_feature (5)..(5): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgaagtccatctgacccatcttaagatgggtcagatggacatgggggtggggtggtctccccacctcctcacattatgcctacaagaacacagacacatgcaggtgcctttgcagaaacaaagtcagggttcttcaagtcacaaagggaagggcaggaacaaatcttgcctctcagtcccacacaaggcagctgtctcacactatagaaaaaaatattcatgaacaaattcgtatctgtcacagtgaggagtcactttaaatcagcccatcgcatgctcaataattacgcccg

SEQ ID NO: 323894 - DNA, 786 bp, Homo sapiens
  misc_feature (1)..(2): n is a, c, g, or t
  misc_feature (5)..(5): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagcgttccctgtcctgagaaatcttccagccctccttaatgggatggaatctgctggaatcataaaa

SEQ ID NO: 323895 - DNA, 741 bp, Homo sapiens
agcacttttcccaagataggtaacttccaaaatgcttttaagcagtgaataaaaataaatctttgacaaaaaaaagacacacacacacgcaacaaaatctttgaatacatttttaaagctcccaacttttgggctaggctccactacacatttagcttgttgccaaattacactctaggtaagtggagaaattccattttaataatagaatatatctttaataatataaatgatgaaatagaggtgagttcatataacttgattggccacattatttcgtggtatgacatatcccacattatagcgaattaatatctaatggtttttttctgtgaatcctcccaatgtgttatttgctcccttgcttggaacttcagagttcactggaagtttttgttttctttctgcagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaa

SEQ ID NO: 323896 - DNA, 867 bp, Homo sapiens
  misc_feature (2)..(2): n is a, c, g, or t
  misc_feature (43)..(43): n is a, c, g, or t
  misc_feature (92)..(92): n is a, c, g, or t
  misc_feature (98)..(98): n is a, c, g, or t
  misc_feature (125)..(125): n is a, c, g, or t
  misc_feature (494)..(494): n is a, c, g, or t
cnatgaagagagatcttataagagaagtgtgagactggatgangaactgagggaagcatcaaaggcagctaaaactagctgcctttacaatnatccanaaatgtcttctatggagaaggatattnacttgaagctgaaagaaaagccttagttggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaaaaaaaaaaaaaaaaaaaaaaaaaaaaaaaaaaaaaaaaaaaaaaaaaaaaaaaaaaaaaaaanaaaaaaaaaaaaaaaaaaaaacaaaaaaaagaacaaaaaaaaacaaagacgaaaagcaaagacaaaagaggagggcgggccgccgcgcggcccacagaacgggggacgaacgacacaacctcgggggggggggcgcgccgcgcgcgagcgtcacgacgcgtgagatgcccgtctctcacaccgcgccgcgggccgccccaccacccccagtgcgggatgcgctgtcacacggcagcacaaacacgctccgggcggccagcacacgcttgggtggtcgtagcacaccaaccaaactcgaggtgctcagcgaacctgacggacgccctaatcgcagcaggggggaccctccaaggtcgcgcccgactgatcccgc

SEQ ID NO: 323897 - DNA, 409 bp, Homo sapiens
attgctttataaataaaccagaccaggacttgcaacctaaaaaaaagcctctcgtttgtttttggggtaggcgtggggtggggcaggtgtttgctttgacaccctgagcattgtcaaagttcagtaccacaaggttcatccagatgaattaatatgacagttagctgggagttataatgctaacttttgatttcatattttgagacagaatcatgaatatatttcatacctgaaaagcagattaaggtttagttccatataagtaagaaatgaaattgaataagatagttctctagaattagttgctgcagatgacactgaagattattttaacatatgttccagttgtttttgtaaccttgcagaaaatacacatatattgataatgagaaagtcaaagattatttta

SEQ ID NO: 323898 - DNA, 1535 bp, Homo sapiens
  misc_feature (1)..(2): n is a, c, g, or t
  misc_feature (5)..(5): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaa

SEQ ID NO: 323899 - DNA, 1971 bp, Homo sapiens
  misc_feature (1)..(2): n is a, c, g, or t
  misc_feature (5)..(5): n is a, c, g, or t
  misc_feature (1598)..(1598): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaaaaaaaaaaaaaaaaaaaaaaaaaaaaaaaaaaaaaaaaaaaaaaaaaaaaaaaaaaaaaaaanaaaaaaaaaaaaaaaaaaaaacaaaaaaaagaacaaaaaaaaacaaagacgaaaagcaaagacaaaagaggagggcgggccgccgcgcggcccacagaacgggggacgaacgacacaacctcgggggggggggcgcgccgcgcgcgagcgtcacgacgcgtgagatgcccgtctctcacaccgcgccgcgggccgccccaccacccccagtgcgggatgcgctgtcacacggcagcacaaacacgctccgggcggccagcacacgcttgggtggtcgtagcacaccaaccaaactcgaggtgctcagcgaacctgacggacgccctaatcgcagcaggggggaccctccaaggtcgcgcccgactgatcccgc

SEQ ID NO: 323900 - DNA, 1326 bp, Homo sapiens
  misc_feature (1)..(2): n is a, c, g, or t
  misc_feature (5)..(5): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtatggaatctgctggcatccatgaaacaacttacaatagcatcatgaagtgtgacattgatatcccaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctaaaaaa

SEQ ID NO: 323901 - DNA, 1014 bp, Homo sapiens
  misc_feature (1)..(2): n is a, c, g, or t
  misc_feature (5)..(5): n is a, c, g, or t
nncangaggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacgaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactgctgaacgtgaaattgtccgtgacattaaagagaagctgtgctatgtcgccctggattttgagaatgagatggccacagctgcctcttcctcctccctggagaagagctatgaactgcctgatggccacgtacatggcagggacatccttggggttcagcggggcctctgtgagcagggtggggt

SEQ ID NO: 323902 - DNA, 327 bp, Homo sapiens
gcagacacagacgtgtgtgtgtataaaattataatcacctacttgctattaaaggaagagaaccaggtgctatgagaaaatgaaatatgggcctaatttagaaggagggtggtgaaaatgtagtcaatgaaggcttctaaacttgagtgagttttactagatttggggaagggattgatgagtgttccaagtggaaggaatcgcatgtatttgaaattatcaaggtgggaaatattcaacttgtcatggaatggaaggaatggcagttcacatggagggtgactgaatgagaaaggaaaaacaaacaaatttagattaagggtgtag

SEQ ID NO: 323903 - DNA, 514 bp, Homo sapiens
  misc_feature (3)..(3): n is a, c, g, or t
  misc_feature (7)..(8): n is a, c, g, or t
gcngccnnctactactactaaattcgcggccgcgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323904 - DNA, 503 bp, Homo sapiens
gctgccgcctactactactaaattcgcggcgctcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323905 - DNA, 739 bp, Homo sapiens
  misc_feature (675)..(675): n is a, c, g, or t
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacatttgggggggcggcctgggcccagaaaaaggttttaaacaccattcgtgtgggggcggcgggcccagtgggttagtacaccttggccaaagggggcccaaagagaacccgggccagacatgggggtgggtttcccccataaaaaaccgcgggggcaccggnggtctggaccaactccaggggtcgggggccacggtcaccacgggtcccgaaccaaaataggagg

SEQ ID NO: 323906 - DNA, 733 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaacaaaaaatggtggggggcgctcccggcccggaaagtttttagaacccctcccgttggggggggccgggcccaggggttatggcacttgggccaaagtggccaagggaacccgggctggctggcttgggtttcccccaaaaaaaaacgcgggggacgggggtttggacatccgaggggtccggcgctcggtctcacaggcccgggtctaacccgggggggga

SEQ ID NO: 323907 - DNA, 625 bp, Homo sapiens
ggaggtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323908 - DNA, 503 bp, Homo sapiens
gcctactactactccccggggggcggccgcgtcgacctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323909 - DNA, 725 bp, Homo sapiens
ggaggtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccaggatcacatcttggagatgaaaaggtgaaatcaaatgttgtaaacggttttaagaatgtggatatatagtagcaaattgttctccttaacgattgttcaaaaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323910 - DNA, 763 bp, Homo sapiens
  misc_feature (616)..(616): n is a, c, g, or t
  misc_feature (624)..(624): n is a, c, g, or t
  misc_feature (659)..(659): n is a, c, g, or t
  misc_feature (673)..(673): n is a, c, g, or t
gctgccgcctactactactaaattcgcggcgctcgactgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacacaaaaaaaaaaaaatttgttggggcggccctgggcccccggaaaaagttttttagacccatcgttgggggcgcggcgggccccactagggttangggacaangggccaaagggggcccagaggagaacccgggcaanagaaggggggggtncccccataaaaagccgcgggaaccgcgtcgaccatccagggtgcgggacacggcttataccggccacagcgaaatcgccgcggagggggc

SEQ ID NO: 323911 - DNA, 689 bp, Homo sapiens
  misc_feature (3)..(3): n is a, c, g, or t
  misc_feature (7)..(8): n is a, c, g, or t
gcngccnnctactactactaaattcgcggccgcgtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaaaaaacaaaaaaaaacggtgggcgccggcctgaaaattttaaccatcgggggccggcccaggacggaacggcacaggggcccaggaaacggcgaaaagggggtcccccaaaaagccgggacccgggtgaaaccaggggcgggccagggctaacgggccggcgaaac

SEQ ID NO: 323912 - DNA, 654 bp, Homo sapiens
gtcgccttaaaggggaaaagctggtagtgcctgcaagggcccggtccggaattcccggggtcgacaaattattaaattttcggccgggtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaacacttgaatatgtgtgtccttttaatttataatttatgtatgcattgatttaatacacattataaagaatacaaacatttaaaaa

SEQ ID NO: 323913 - DNA, 370 bp, Homo sapiens
  misc_feature (3)..(3): n is a, c, g, or t
  misc_feature (7)..(8): n is a, c, g, or t
gcngccnnctactactactaaattcgcggccgcgtcgacaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323914 - DNA, 501 bp, Homo sapiens
gcattcctctctccctgccaggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323915 - DNA, 703 bp, Homo sapiens
  misc_feature (631)..(632): n is a, c, g, or t
ggaggtacctgtctataaggagtcctgcttatcacaatggggctcccaaacttggctgtgcagtggaaactccgggggaattttgaagaacactgacacccatcttccaccccgacactctgatttaattgggctgcagtgagaacagagcatcaatttaaaaagctgcccagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaagccccnnataggacataatttcgatttttttcccattcactatttagttaatagtacttggggggggcccggccccaa

SEQ ID NO: 323916 - DNA, 916 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaaaaaaaaaaaaaaaaaaaaaaacaacaaaaacgtgtgtggggcagcacgagaccctagcaaaacaggttcttataccacaattggtgtggggggcgcggggaccccacaggggtacgtgacacacttgtggcacaaggcgtgtcccaagaggagacccggtggcatcagacacacgtggtcggggcatccctcccacaataaaaaacgcgccaggggggcaccaacgcagcgtgctggaacaaaatcgagagggggatcgggagggccacaacgggggacttcataccacgggggggtccaaagggagagactccgacataacaaaattacgccccggcgccgggggggagtgcgacagaggacacatcagcaaacaccacacggagcacagggcaacaccacataacacaccaaatcaacacctacgcacgacgacacgtcagcgcgcgaacgaccgcacgacgacaagaccagaccatcaacgaacgagtaccaacgagagcgtcgcgagacaccgcgacgcacgcagaacgcagataacgaccaacgacacagagcgtaccaccgcagacacctagaccaccatcacgacacaccaacgcacagagatgccacacacagcaa

SEQ ID NO: 323917 - DNA, 723 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggagtaagtcttggcttttcaatgtttattatgttattgcagcctggtagatggacctgtctgcagatgaaagcctttgtgtttctgtttgtttgtttctttgttttttgagatagtcatgctctgtctcccaggctggagtgcagtggcaccatttcagctcactgcaaactcctcctcccgggttccagtgattctacctcctcagcctcccaagtagctgggactacaggtgtgtgccatcatgcctggctaatttttgtatttttggtaaagatggggctttgccacgttggccaggctggtctcgaactcctgacctcaggtcatctgcccgccacagcctcccaaagtgttgggattacaggtgtgagccactgtgcctggcctcacttgggcagccttctaagaacacagtagcctgggccctgtacccagagatactgatttcattgttctagggtaaggctgagacatgggtggctttcaagtacccaagatgtttcacatgtgcacccagggttgaaaaccaccgatgcaaagcaaagggaagtgtagaagtgagattctcatccagagat

SEQ ID NO: 323918 - DNA, 665 bp, Homo sapiens
ggtgcttgttggctttaacatccacaatgaacacaagtgtgttgttgtcttctatcttcttcgtggtgactcagtggtcagcggaaacttgatgatagcgtagtggtcaagcttgtatctcctgggagtcgactcttccaaagatatttgggctgcctcgggagttgcagcgtcttgggccgccggaaggtgggtgacgtacggatcttctttttttgtgtggctgtggacacctttcaacactgtcttcttggcctttaaatccttcgctttggtttcggctttaggaggggcaggagcttccttcttcactttcggcgccatcttgtgaaaagggaaagtttcctttctaataccattttcacttctcccgaattttgtggatcgtttcttggtatctaccccagatttcaggagtgttggctggatcttagggattgtgaagtcttcatttccctgtggtgagatctgaggcatgattttaaacagtgtgagggaaggagatctccaggcactttaatagaatggagaagcaggatgggatttgagaggaaatctgattttgaaaaaaggagaactagagttgagttcgtaattaactagcaccttaaaggtcattcagcatgcccatctgcacagtgggtgtaatcaccctacagaacaaa

SEQ ID NO: 323919 - DNA, 641 bp, Homo sapiens
ggtgcttgttggctttaacatccacaatgaacacaagtgtgttgttgtcttctatcttcttcgtggtgactcagtggtcagcggaaacttgatgatagcgtagtggtcaagcttgtatctcctgggagtcgactcttccaaagatatttgggctgcctcgggagttgcagcgtcttgggccgccggaagaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323920 - DNA, 751 bp, Homo sapiens
  misc_feature (604)..(604): n is a, c, g, or t
  misc_feature (612)..(612): n is a, c, g, or t
  misc_feature (647)..(647): n is a, c, g, or t
  misc_feature (661)..(661): n is a, c, g, or t
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaacacaaaacacaaaaaaaaaaaaatttgttggggcggccctgggcccccggaaaaagttttttagacccatcgttgggggcgcggcgggccccactagggttangggacaangggccaaagggggcccagaggagaacccgggcaanagaaggggggggtncccccataaaaagccgcgggaaccgcgtcgaccatccagggtgcgggacacggcttataccggccacagcgaaatcgccgcggagggggc

SEQ ID NO: 323921 - DNA, 784 bp, Homo sapiens
  misc_feature (720)..(720): n is a, c, g, or t
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggcctgggcccagaaaaaggttttaaacaccattcgtgtgggggcggcgggcccagtgggttagtacaccttggccaaagggggcccaaagagaacccgggccagacatgggggtgggtttcccccataaaaaaccgcgggggcaccggnggtctggaccaactccaggggtcgggggccacggtcaccacgggtcccgaaccaaaataggagg

SEQ ID NO: 323922 - DNA, 701 bp, Homo sapiens
  misc_feature (3)..(3): n is a, c, g, or t
  misc_feature (7)..(8): n is a, c, g, or t
  misc_feature (637)..(637): n is a, c, g, or t
gcngccnnctactactactaaattcgcggccgcgtcgacaaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaaaaaaaaaaaaaaaaaaaaaaaaaaaaaaaaggcgcaaaaaaaaaaaaaaaaaaaaaaaacatttgggggggcggcctgggcccagaaaaaggttttaaacaccattcgtgtgggggcggcgggcccagtgggttagtacaccttggccaaagggggcccaaagagaacccgggccagacatgggggtgggtttcccccataaaaaaccgcgggggcaccggnggtctggaccaactccaggggtcgggggccacggtcaccacgggtcccgaaccaaaataggagg

SEQ ID NO: 323923 - DNA, 568 bp, Homo sapiens
gtcgccttaaaggggaaaagctggtagtgcctgcaagggcccggtccggaattcccggggtcgacaaattattaaattttcggccgggtcgacaaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323924 - DNA, 408 bp, Homo sapiens
  misc_feature (3)..(3): n is a, c, g, or t
  misc_feature (7)..(8): n is a, c, g, or t
gcngccnnctactactactaaattcgcggccgcgtcgacaaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323925 - DNA, 386 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacaacctggttggggggtttaacttggaccaaaaagggaacaaatcttggccaaaaagcaattctttcaagaaaggacggactggcaaggtatattcgtgcgtggagaagaaggacccaaaaaaagac

SEQ ID NO: 323926 - DNA, 564 bp, Homo sapiens
  misc_feature (8)..(8): n is a, c, g, or t
  misc_feature (62)..(62): n is a, c, g, or t
  misc_feature (66)..(67): n is a, c, g, or t
  misc_feature (92)..(92): n is a, c, g, or t
  misc_feature (112)..(112): n is a, c, g, or t
ggtacctngttctactacaggacgtccgtgcttatcacaagtgacatgttcttccgtgtggncacnnctgttgttgaatcctttgttgggcncaaaccctttttttccgggntttggggaaaccttttttttttaaaactttggggccccaaaaaattggggccattttcaatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323927 - DNA, 666 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaaaaaaaaacaaaaaacaaaaaaaaacggtgggcgccggcctgaaaattttaaccatcgggggccggcccaggacggaacggcacaggggcccaggaaacggcgaaaagggggtcccccaaaaagccgggacccgggtgaaaccaggggcgggccagggctaacgggccggcgaaac

SEQ ID NO: 323928 - DNA, 789 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaacaaaaaaaacaataacacgacacaacagactaaaccactcgttgtcgggccacgctggcgccgctacaaaaaaaagtgttacgagacacccaatgccgtgtgggcgccgcggcaccaggtaggctagctggtaaccagttgccactaggcagtgttcacaagggaaaaaccctgcgcgcgagaacaaggcggtgggacgcctccccgaataaaaaacgccggggggacacgcaggcggctccggaaacaactccgggagggcgtcggaagccacaaaggggcccaccaaagcggccag

SEQ ID NO: 323929 - DNA, 491 bp, Homo sapiens
ggaggtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaaagatttttgagcaaa

SEQ ID NO: 323930 - DNA, 1510 bp, Homo sapiens
ttaaatgcccagttcaagattttttccttctccaccttcccctggggttgactttagatctgggaggtttgggatttagggagaggcttcagggtcctgggaggtgctctgtcctaccctggtgttcttcctggctagtcctgggcatggctttccctccagggtggcttctgtataagcatcttcagtcccatttggtccctgtcccgtggtccgagcctgacatatgtgcccatcccaaggcctctccagccttaccatcctccaagacacatcagtgcccctctctgccctgtgtgaaaatctttggtttctccgttgaaactattcagggggctgcatcaagcccagcttcctagggccagtgggtggtcctccctataccacaccttaggtgtggtggcaagaggcattctcttttcgtgtcatctcccaggccattcaggggatacagctcatgtgcccttcactcttggttttctaccctccccaggagttctgccctctaccccgaggctctgctgggggccaggcagagagctcttctccagggaactcaatagtgtctgccatcatcctctcctctcggacttctcttccatagtccaaggagttactttctatcccagggctaggaaggttaccactggaaactctaaagccaagaattaacttctgtatcaataacctctataccaataagtgcagaaaatacatcagacacagtccaatctcattcatgataaaagtgctcaacagactgagaataaaagggaattttctcagcctgatactgagcatttatgaaaagtccacagctcacatcatattaatatttaatcgtgaatgactggatcctttcccactaaaatcaggaacaaaacaagaatgtgtactctcaccacttctattcaacattgtattggaagttctagccagaaattagccaaggaagtgaaagaaaaggcatccaagttggaaaaaaagaagtcagttacctctatttacagataatatgacacagtttaaaaagtgagggttgtgcaacctgccaatgtactaaaatatattgaattatacgcttcaaatggatgaattgtattgcatgtggtatatgaagcgtatctcaatgaagccatctgtttgctgttgttgttgttgctgctgttgttgttgtttgtttttttttaagacaggatcttgctctgttgcccaggctggagtgtagcggtgcaatcatggcttactgcaccctcgacctcctaggctcaagtgatcctcccatctcagactccgagtagctgggactacagttgcatgtcaccatacccagctaagttttgtatttttcatagagactgggtttcaccatattgaccaggctgatctcaaattcctgggctcaagtgatcagcctgcgtcagcctcccaaagtgctgggattttaggcatgagccactgtgcctagctaaagccatgtttttaaagtgataaaaataaagaatgaaga

SEQ ID NO: 323931 - DNA, 753 bp, Homo sapiens
ggcactttcccagtccccgaggcggatccggtgttgcatccttggagagagctgagagctcgagggacggggatttcgctatgttgcccaagctggtctggaactccggagctcaagcagtccgcccgccttggccccccaaagctctggaattacaggcgtaatgcactgtgcctggccttttaaaaaaaaattgaggttattttggggacagtagagcgtccagacacatcctaatttgcgtagctgctcagttttaaaaaatgcaatgcatttttacctcttagggtatgtgatttctggctggtaagctacaccgaatcttggctagcacagttgaattccatgtcagatttgtaaacgcaaatttgctctctgcatttaaatatattagatatatttaggtaactacatttaaatgtattgagacatttaaatacacttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagaggttgcagtgagctgagattgcaccactgcagtctagcctgggtgacacagcaagactccatctcaa

SEQ ID NO: 323932 - DNA, 851 bp, Homo sapiens
ggcactttcccagtccccgaggcggatccggtgttgcatccttggagagagctgagagctcgagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccaaa

SEQ ID NO: 323933 - DNA, 1023 bp, Homo sapiens
ggcactttcccagtccccgaggcggatccggtgttgcatccttggagagagctgagagctcgagggacggggatttcgctatgttgcccaagctggtctggaactccggagctcaagcagtccgcccgccttggccccccaaagctctggaattacaggcgtaatgcactgtgcctggccttttaaaaaaaaattgaggttattttggggacagtagagcgtccagacacatcctaatttgcgtagctgctcagttttaaaaaatgcaatgcatttttacctcttaggtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactccaagaagagcccaagaagacattactactaactgtcacatggtgtcacggatgggatcttcggacagaaaaaggaaattgggccaggcgcggtggctcacgcctataatcccatcactttg

SEQ ID NO: 323934 - DNA, 1031 bp, Homo sapiens
ggcactttcccagtccccgaggcggatccggtgttgcatccttggagagagctgagagctcgaggtgagctgggctcgcggtcgcccctctcgctcgccctctttgagaaccacggcttccgacctccctggaaatggggggaacatggccgaggcgcgtgggaggccgcctcgtggaggccccggagcggcatcctcagcgccccagcgatccggtgcccattaggtgcgccttgaagccgagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccaaa

SEQ ID NO: 323935 - DNA, 326 bp, Homo sapiens
ttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcaccaatggttcctctcctccttcctgatgtctgccattagcattggaataaagttcctgctgaaaatcca

SEQ ID NO: 323936 - DNA, 836 bp, Homo sapiens
ggcactttcccagtccccgaggcggatccggtgttgcatccttggagagagctgagagctcgagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcaagagtttgccgacctaactcgggttgaaacttttggctttcgggggaaagctctgagctcactttgtgcactgagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaacctattgatcggcaagtatgtacttcgggaccctatagaccacaccgta

SEQ ID NO: 323937 - DNA, 256 bp, Homo sapiens
tataaagtaaatatacatgagtccatactgacataagtaaataaatgggggagaacaggcaactctccagaacagaattccagaagattatgtagatactccaccaccttggaggaacagggtaacttcccagtccttacgtgtaggctgcacacagtgacttccttccaaagagttatgaaaagggagaaaaagagtaacttcaaagcagagaaacctagccacgtgcaatagctcacatctgtaataccagcac

SEQ ID NO: 323938 - DNA, 533 bp, Homo sapiens
attccaataaaagtaaattgagttaccctagctgttacctggagatgcagaggtaaaagtaactacagtaattcaacttaaaacagtgtttttcaaactttaaaatgaagaaggttcatttggtaattttgataaaatatagattctaatctgtaaatcacatggggcctgttcttctgcatgtctaaaaagctgctcagtaatggccaggaatacacctttgaataacaagaatttaaaatattaatgaggataaaacgtaattgattcaaatgttttaaagctctgaaggcttgcaaatctaagttataaatattaatctatttagaacttttcaagtatgtaaatgaatgtactgattttttttttaataaaactggtctaatggtatcaagctttggaatctcatttttagtgcctccattgaaatgctccatctctcattagtcaccgtgccttacttttttcaactttaaaattggaagaatactttctactttttttgttttttttttttaaatggagtttcactc

SEQ ID NO: 323939 - DNA, 171 bp, Homo sapiens
ctcccaaagtgctgggattacaggcttgaaccaccttgaccagtcagactttataattggttttagtaactccttccattcatttactcatccactcactcactgagcaaccacgtggataccagcatcttcttggacagtgccaggttctggggtacagaggtgaataag

SEQ ID NO: 323940 - DNA, 816 bp, Homo sapiens
gcaggagaatcacttgaacccgggaggtggaggttgcagtaagccaagatcgcgccactgcactccagcctggggaacagagcaagactgtctcaaaaaaaaaatgaagtaaattaaaaacaacaaaacccatgttccgtaatcccatatatagtcactccaccgtgcaaagctgactatgcacattgaacaggaatgtgcccttacagggatcagtgtccttcagggatgtggctatcgatttcagcagagaggaatggcggcacctggacctttctcagagaaacctgtaccgggatgtgatgctggagacctacagccacctgctctcagtaggtaagcacagtcaccttggtatctgaaaggaggcctcactgagagtgttttcattctcagttgacgaatgctgttggcatcttagataggtgatggttttgtccttttttcctccagggttctctgtttgtttagggtactcagaatattactcagagatatctggttactttcctaaagaacaaaccatcattgaacaataagactgtatttgttgggctctgaaacgtaattagctggacccagacctttatcatttcccatgaacagggtatcaagttcctaaaccagaggtggtcatgttggagcaaggaaaggaaccatgggcactgcagggtgagaggccacgtcacagctgcccaggtgagtgaagtgaggtgaatgtgactcaggttagatgggagacaggaggaaatctcagctgtcttgaaaaacactggaacctgtgaagtgctattaagaccactcttcagtaaggct

SEQ ID NO: 323941 - DNA, 239 bp, Homo sapiens
cccagaaatcctcagccctggctccagaggatcatggcagctcctatgaggtatataggtaccattttcaaagaaatgatgttctgagccctataagcacaatcaatatgcatcacaagagacaaactgtaatctctgaatgcagttaaatgaagaaatcaacaagggggacagagttttgctcttgttgcccaggctggagtgcagtggcacaatcttggctcaccgcaacctctgcc

SEQ ID NO: 323942 - DNA, 503 bp, Homo sapiens
cccagaaatcctcagccctggctccagaggatcatggcagctcctatgaggtatataggtaccattttcaaagaaatgatgttctgagccctataagcacaatcaatatgcatcacaagagacaaactgtaatctctgaatgcagttaaatgaagaaatcaacaagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggtgagtgaagtgaggtgaatgtgactcaggttagatgggagacaggaggaaatctcagctgtcttgaaaaacactggaacctgtgaagtgctattaagaccactcttcagtaaggct

SEQ ID NO: 323943 - DNA, 385 bp, Homo sapiens
cccagaaatcctcagccctggctccagaggatcatggcagctcctatgaggtatataggtaccattttcaaagaaatgatgttctgagccctataagcacaatcaatatgcatcacaagagacaaactgtaatctctgaatgcagttaaatgaagaaatcaacaagagcaaaactctgtctcaaaacaaacaaaaaaactggtttttatgagactcatacaataggggcagaactcccagataaataaatcaaaaaaggaagtggaccaggtgcggtggctcatgcttgtagttctagcactttggaggcaagaggatcacttgaagccaggagttcaagaccagcctaggcatcatagcaagactctgtctctacaaaaaaaaa

SEQ ID NO: 323944 - DNA, 364 bp, Homo sapiens
catggaagacagatgtttaaagatctttctctagcataactgcaggcagggcctggccctgcccaacactcagtatatttagctgtaggatgccacacagtggttaataccatgtgtttattttgtagctcctagacagcagagagattataacctgcttttgcaaatgataaaatggaacctcaccagctaagtaatatagacctataaactagcaaaaccagatgtttacttctgccatggtttgaatgtgtcctcgaagttgatgtattggagagctgggcatagtggctcatgcctgtaatcccagcactttgagaggactgggtgggtggattgcttgagcccaggagtttgagaccag

SEQ ID NO: 323945 - DNA, 299 bp, Homo sapiens
tgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctggtgacatgcaatttacctatatagcaagcctacacatgtgcccctgaacctaaaaaccaacgttaaaagaaaaacgtttggattattttccctctttcgacagacattggtttgcccaggatactcacaggcgtc

SEQ ID NO: 323946 - DNA, 1160 bp, Homo sapiens
tgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgtccccgtacatcgttagaagcttgaattcgagcagtagtagtagtaggcggccgc

SEQ ID NO: 323947 - DNA, 903 bp, Homo sapiens
tgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgagtgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 323948 - DNA, 419 bp, Homo sapiens
cactgtttatccatggccaagtgactttacctctctgagcctcagtttctgtcaaggaagataacagttctttctaaataaatcatataaagtgtccagcacaatgtcaagtgtgcagtagcaatgaataaaagggtctccctccttcctttcctcttccagattcctcggacaccacaccctgctgctttgcctacattgcccgcccactgccccgtgcccacatcaaggagtatttctacaccagtggcaagtgctccaacccagcagtcgtgtgagtctcagccccatggagccctcccagagcctgttccctgaggagtcctctgagaggatgccctacccacttccacctatcctccagctgcaagcagccacagctcctccatctctagcctcagagtcccctgctatcatgt

SEQ ID NO: 323949 - DNA, 1237 bp, Homo sapiens
tgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 323950 - DNA, 1055 bp, Homo sapiens
tgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 323951 - DNA, 992 bp, Homo sapiens
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323952 - DNA, 474 bp, Homo sapiens
agcgcttctgtcccttctcctcgaactctgcccctgtgaccttggcctcactccaaacggcgtcgcagcggttgacttcagatgcttctcctgccttcaggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323953 - DNA, 718 bp, Homo sapiens
ggcgccagcccacaggaaggggcggggatagcacctaggagctgggcatagagaggtggggcctaggccccagcttgtggccgaccccgcccatcctcgagcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacggtgagcggcctctgtccccgactttgtggtcgctggtgggatgtgcacccgggagctgggggagcacaggaccctggcccagtgcgggtggctaaggcttgtcggaggaggtgaccactgaaggctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323954 - DNA, 720 bp, Homo sapiens
ggcgccagcccacaggaaggggcggggatagcacctaggagctgggcatagagaggtggggcctaggccccagcttgtggccgaccccgcccatcctcgagcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttcggtataaaaaaatagcgtttttatcccctccttcttgatatacccctcctctttcttcacctcatatcctaacaaaatactggccgccgtttaaacgcgcggactggggaacaccctggcgccct

SEQ ID NO: 323955 - DNA, 227 bp, Homo sapiens
  misc_feature (28)..(28): n is a, c, g, or t
aacggctgcgagaagcacgacagaagtnccggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323956 - DNA, 324 bp, Homo sapiens
ggcgccagcccacaggaaggggcggggatagcacctaggagctgggcatagagaggtggggcctaggccccagcttgtggccgaccccgcccatcctcgagcaggtaccagggccacgtgggtgcatcgctgatcgtgggcggcgtagacctgactggaccgcagctctacggtgtgcatccccatggctcctacagccgtctgcccttcacagccctgggctctggtcaggacgcggcctgcggtgctagaagacggtccaccgacatgcgtgagctgtcagggctgtgtgaagcgcacgcggtctggtgactggtcggcaat

SEQ ID NO: 323957 - DNA, 1491 bp, Homo sapiens
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacaaaatggctgtgtcattcttgagtggaatggggtgggcaggcagccagcagggctctgtagctaaggcgtccctgcaggggccattacctaccatagctctagtgtctggcctaagagatgcccttcacccataacctcaggcacctacaactccagaaccccagccctggccagcattgcaggcttggtctccacccaaaccttccttctgactccacacttgaaggctcccccaccactccactgtcttgctcttgccctctagtccactggagacttgtaaattatgaaataccccatgtactaccccctcctagagactttccatggctcctcagtggcccaggacaaagctcatacctttcaatcaggcccccacaggccccactgagggctaaagtgctgacaagaggagccgctccctgactccaaggcaagttctcaccaagcactcctcaacctcgcaacatctttacctgtgacaccccttagat

SEQ ID NO: 323958 - DNA, 1090 bp, Homo sapiens
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacaacacacgaaatgacaatacaacaatataatcactgaatacgtaatacacaactacaacataccacaaagaacaatgaccacaacagagggggg

SEQ ID NO: 323959 - DNA, 1103 bp, Homo sapiens
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctagtgagactcccgagcccagttcccgtacgcaaaaaagaacggccccctcgttcccactccggtccccgcacgtcccagccctgcccacaccgatcctcccttttgcctcagctgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323960 - DNA, 1463 bp, Homo sapiens
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacggtgagcggcctctgtccccgactttgtggtcgctggtgggatgtgcacccgggagctgggggagcacaggaccctggcccagtgcgggtggctaaggcttgtcggaggaggtgaccactgaagggtgagtggagtaagggcagagaagtgcggtcccgacataacaccgtccaataccaaagcctgcacggctgggagaagtcgaagctcacagaggatctttaggagccgagggcggagagaaggaccagtagggtcctacttatatcaacgtctggagcctagattttgtttggggtgggatggaagcaggtgatgttgcctcagaggtggctaaggctcagagggagaaacacagtgggggtttggagggcaagaccagattgggtaagtggacaggcaagtccccaggctgtagcctaagttaacagcagagagagcccgttaggtctcacacacccatcaccgcagctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323961 - DNA, 691 bp, Homo sapiens
  misc_feature (580)..(580): n is a, c, g, or t
  misc_feature (628)..(629): n is a, c, g, or t
  misc_feature (673)..(673): n is a, c, g, or t
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcagacgccaagagcttctcgctgaacctgggcaaagatgacaacaatctgtgcctgcacttcaaccctcgtttcgaagcgcatggggacatcaacaccatcgtgtgtaacagcaaggacggtggggcctggggggctgagcagagggaatctgccttccccttccagccatgaagtgtcgctgaggtatgcgtctnctttcacgagacagacctaaccatcaagctgcctgatggatacgaatnntcagttcctcaaccagctcaaccctggatggcatcaactacctntggctgcagtggtgactt

SEQ ID NO: 323962 - DNA, 594 bp, Homo sapiens
ggcgccagcccacaggaaggggcggggatagcacctaggagctgggcatagagaggtggggcctaggccccagcttgtggccgaccccgcccatcctcgagcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323963 - DNA, 692 bp, Homo sapiens
ggcgccagcccacaggaaggggcggggatagcacctaggagctgggcatagagaggtggggcctaggccccagcttgtggccgaccccgcccatcctcgagcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacaacacacgaaatgacaatacaacaatataatcactgaatacgtaatacacaactacaacataccacaaagaacaatgaccacaacagagggggg

SEQ ID NO: 323964 - DNA, 992 bp, Homo sapiens
  misc_feature (21)..(21): n is a, c, g, or t
ccggcagtaactcacggctangtagcgaggctgggtggcgctttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323965 - DNA, 951 bp, Homo sapiens
gaacaggtgtctaacacgcacgctgtgattgtgagccgtacttcttggctatggggggctgagatgggctccaacgagcatggtgtctgcattgtcaaccaggctgggtggtcgaacgagccaattggccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagtt

SEQ ID NO: 323966 - DNA, 1514 bp, Homo sapiens
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagagaggctgtccctcctccctcccaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacaaaatggctgtgtcattcttgagtggaatggggtgggcaggcagccagcagggctctgtagctaaggcgtccctgcaggggccattacctaccatagctctagtgtctggcctaagagatgcccttcacccataacctcaggcacctacaactccagaaccccagccctggccagcattgcaggcttggtctccacccaaaccttccttctgactccacacttgaaggctcccccaccactccactgtcttgctcttgccctctagtccactggagacttgtaaattatgaaataccccatgtactaccccctcctagagactttccatggctcctcagtggcccaggacaaagctcatacctttcaatcaggcccccacaggccccactgagggctaaagtgctgacaagaggagccgctccctgactccaaggcaagttctcaccaagcactcctcaacctcgcaacatctttacctgtgacaccccttagat

SEQ ID NO: 323967 - DNA, 1546 bp, Homo sapiens
  misc_feature (1483)..(1483): n is a, c, g, or t
  misc_feature (1546)..(1546): n is a, c, g, or t
agcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggtgtgcatccccatggctcctacagccgtctgcccttcacagccctgggctctggtcaggacgcggccctggcggtgctagaagaccggttccagccgaacatgacggtgagcggcctctgtccccgactttgtggtcgctggtgggatgtgcacccgggagctgggggagcacaggaccctggcccagtgcgggtggctaaggcttgtcggaggaggtgaccactgaagggtgagtggagtaagggcagagaagtgcggtcccgacataacaccgtccaataccaaagcctgcacggctgggagaagtcgaagctcacagaggatctttaggagccgagggcggagagaaggaccagtagggtcctacttatatcaacgtctggagcctagattttgtttggggtgggatggaagcaggtgatgttgcctcagaggtggctaaggctcagagggagaaacacagtgggggtttggagggcaagaccagattgggtaagtggacaggcaagtccccaggctgtagcctaagttaacagcagagagagcccgttaggtctcacacacccatcaccgcagctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaaaaaaaataatcactgcncgtcgttttaaacgtcgtgattgggaaaccctgcgttccccaactaaacgccttgagacatcn

SEQ ID NO: 323968 - DNA, 820 bp, Homo sapiens
tttttagctgctcactggccccgcttgtctggccgactcatccgcccgcgacccctaatcccctctgcctgccccaagatgctgaagccagccctggagccccgagggggcttctccttcgagaactgccaaaggtgaagcgggggcgcggggggcggtcactcctgagccgcctctgcttgctcgtggccttttttcctggctgggggtgggggagggtgtgttggtcgacttgggttccaggcttaccccggaagatgagggagacggggaccaggttaggggaagcaacaggggtcttgaaagcagagccgaaacatgggcgccctcctccgtttccagaaatgcatcattggaacgcgtcctcccggggctcaaggtccctcacgcacgcaagaccgggaccaccatcgcgggcctggtgttccaagtgagcagcggggagggacggggagctggaggggagccgagagtatcgagcaggcactgaagctgcggtccctccctctcctcaggacggggtcattctgggcgccgatacgcgagccactaacgattcggtcgtggcggacaagagctgcgagaagatccacttcatcgcccccaaaatctagtgagactcccgagcccagttcccgtacgcaaaaaagaacggccccctcgttcccactccggtccccgcacgtcccagccctgcccacaccgatcctcccttttgcctcagctgctgtggggctggagtagccgcggacgccgagatgaccacacggatggtggcgtccaagatggagctacacgcgttatctacgggccgcgagcc

SEQ ID NO: 323969 - DNA, 759 bp, Homo sapiens
tatacttcctgtagggcttgcagatccaagagtcacttactcctctttttcttatggattacctcatctccagtatttctttatagcagagcaagaacagcctaatacacctgccaaaccagaataaactgtgcttgtccaataactcctgtatcccgtagcttgaaataaatcaccaaaaaaatctaaaatcttcatatgtttataaacatcacttctatctttaaagagtaattaggatagtggataaatattaaaaaggaagatgtttcctggtgtgttacgactgtgccatttgatgtgggaaatttctgagtttcttctttgaggcagaacaacaataatgaagagccaatttaaatgtttttcactgcacagaagaaaaatgaacctgttttggtcctgttgttttgcaagccatcaatcaaaagagccttgaaccaagatgtggcaaaaaatgagatttaataaaagaagcaagttttcaagaagctgctctatgaatctgacatgaggaggagctataataatagccacaccaacttgcaaatgcaaacttttctcctctgattaaattatcttgtaaagatatatacatcacaagaaggtgaataggtttcgtgttacatattaactcagatcaattggtagtgacagcctggagccctgtattgagtgtgactggattctcatttggaccaggtgaggaagaaggcctgactaatgattgatgtctactgttggaaaggatggagggaa

SEQ ID NO: 323970 - DNA, 1100 bp, Homo sapiens
ggggaggctcaagcttcccagaatcccttgtccctccccactttgggcacttaggggtggggctggggagtgagagggacaaggcagggcatgattgattaaagctaacgagcagacagaaggcactggtgggtcacatctcgggcctgggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggaaagaaaaaaacaggggggggggaaaaaaaacacctgtttgattataaaagaagagagccacaccaaggagggcagcgtaaataaaaaaagaagacggaagccagcggcgaaaaaacaaaccgaaggaggaaacaaccccgtccacgggagatctattggagagaagaacaacactaggcgggggggagaaaaggtggaacaaccaccaccagagaataaaggccgccgcagcaaaaaaacgaaggcgggtgatgcggaccacacaggatctatcccgccgagaaagtagccgacgagtaatgaaata

SEQ ID NO: 323971 - DNA, 677 bp, Homo sapiens
ggggaggctcaagcttcccagaatcccttgtccctccccactttgggcacttaggggtggggctggggagtgagagggacaaggcagggcatgattgattaaagctaacgagcagacagaaggcactggtgggtcacatctcgggcctgggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtaccc

SEQ ID NO: 323972 - DNA, 1027 bp, Homo sapiens
ggggaggctcaagcttcccagaatcccttgtccctccccactttgggcacttaggggtggggctggggagtgagagggacaaggcagggcatgattgattaaagctaacgagcagacagaaggcactggtgggtcacatctcgggcctgggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaaaaaaaaaaaaaaaaaaaaaaaaaaaaaaaaaaaaaaaaaaaaaaaaaaaaaaaaaattaataataacttttaaaaataaaaaaaaaatcttaggggggggcccggttcccaatttgcccttatgggagggcgtttaaaaataaattgggccggtttttaacaaggtgggatggggaaaacccttgggtttccccaatttaagcgccttgggaaaaattcccccttttgacaagtggggtttatacccaaaagaggccccacccgatggccctttccagtggccccccctgaatgggaaaggggatttgccggtttttgggt

SEQ ID NO: 323973 - DNA, 1005 bp, Homo sapiens
gacccgatcgcctcccaaaggccctacctccaaaggccatcacattaaggattagatttcaacataggaagtctgggggacacaggcatttagttgataatatcaagcttttacatctggtaaaggaccctgtgaatccgactcaggaagtggtttggtaaagttggaaaggtattggcttgtgactgaggagaggtggctttcctttgttagcatcccatagccggatgctaactttgctgtatttaacgatgctcatcactaagggccgatactgtctaatgcctggtctacctgaaaatgtgcccttcagtgctctagtggtggtgtatttacatctaggcttcctgtcgataagctgttagttaccattgaatccagggagcactttacacactaatcatctttcccagttcacagcctgtttcttatcttctttgtcatgatgtacatttactcatgtctttcctttgctgtaccctgacagaccatttgcccacttgctgcccagcctatttttacccgaaggcttaaatggcctctgaagtctcaagtctacgggaaaataagtaaaacctgcccacatgcttgtgatggtattggaatatttcagtcctttgagaagaacacttcactttgaaccttacgggctattttccagactgtccaaatatgatttgtttcctctcaccatcatttccagtaccctgtcccaagtgtttgaatatagacattgatatgccctgatttttgctctacttcagaaaggatcggggatgtagtttagccctctaggagcttggaactaatttgtttgtctatttcttgtttgcttccaagttgcttattatgtgttacaggtagcagctacagctgaaggccatggtgaattgctggtgatgtaaatactcccagccctgactgatcggccttgtttaaattttaaggattagtaaacaggttgctgctggagctacttctgcttaggctattaggagaataaat

SEQ ID NO: 323974 - DNA, 299 bp, Homo sapiens
ttggctccttgtcaattcaaactggaaaaaaaatgcacagaggagagtgaacaccttctctgttaacatgctgaggaaaattttacaatgaatctttacacagtatttccaaaaaaacaaaaatttatttttatttctttgataaaaatgagtcttctgccctgttaggtgtctggatatttcacctgtaatactcataaaaaatgagaattcccggctgggcgtggtggctcatgcctgtaatcccatcacttttgggaggcagaggcgggcagatcacttgaggtcaggagttcgag

SEQ ID NO: 323975 - DNA, 264 bp, Homo sapiens
aatttgtgcatgtttgtcttgtctggggtgtccggtcatatgctagtgtgtatttaacgtagcaaaaggggtcacatgtttaagaacccacagaagccaggcaagtaatgtaaatgaaagaaccatgccaggcataagagcttttttccattgttcttgagatgttggctatacttgggcaagcttttatcttcacagtttggataaagtcataattcaatacttctctactataaggaaagcaattgcataagaatgacaata

SEQ ID NO: 323976 - DNA, 924 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcggtgagcgggaggcggcgtttgggcccggagacgaaaggaggaggctcctaaagaagcaggggctcgggcggggagggcatcgccgtggggagaggggaacagtggctttcgcgacccatgtttcttcccttgctcaggacccttccttggctccctagtgccctcgaggcaaagttccaacgtggccccccgggcgccaccgccccgcagacctcgcttgcttcgactcggcctctttgctttttcccccacctctaacagccgccctggcctttcggttccttaaacttgccatgcgctttcccgcttcggggattttgcacaggctgtcccttctgcctgcaacatccttttacccattcggcttggctaactcccatttcatccttcgggtctcggcaccaacgtcacttcctctgcgaagccctccttccctgccctccatccagaaatccgcctgttaaatgcttttgtcggtccgtgttccttcatgtcacgtgtggtctaatttgttatccgactcttatctgtgtgctgttttatgatgtctatgaccgtgtgttccatgaaggtagggactaggtttgtctctgtcgccactgtgttctcagcacagcgccaatcacgccggagacgcccagctaatgttcgttgaaggaataaaagatactcctagagccagtttggggaaacagggtagtcatcagattcctaggtagcagtggggcagg

SEQ ID NO: 323977 - DNA, 4156 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323978 - DNA, 574 bp, Homo sapiens
gagcttctgtgtggccctccctatccccaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaagcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323979 - DNA, 406 bp, Homo sapiens
  misc_feature (20)..(20): n is a, c, g, or t
tactactactaaattcgcgnccgcgtcgacggaaacgtcaagtggcccggcagttaggagcttggagctgatagacctgggttcgcgttcacttctcgctttctcactgcgaccttgggcccgtcagtaaaaatggggaagacgttccagtccctccacgctgatgcaaggagtccatgaactcaggcacataaacctctgtgttactgtcactttatgagctggccttcctggtgttgctaacgggactctttagctgtcattacataaacataagtccttcctgcccctctctctagaggcacagggctgcccacatgagaagcagctcagtgacagactagcacttgagattaaaaggtctgctcttccagtttgcaaaaaaaaagtcgacgcggccgcgaat

SEQ ID NO: 323980 - DNA, 514 bp, Homo sapiens
agtgagactccatctcaaaaaaaaaaaaaaaaaaaaagaagcaaaactttcaacttagaaaaactagcaagggattgttcacccttaccccagtggttggtgctagagaaaaaatggaggatgtctgttccacgcagaccctggtggtttaaaacacacatatagatggctctgggaccatcaaaatagcagcagcaaagagccactccaccagcctcccctccactcccccaggccccacacagcagaaggctccagccactttttggaagcctgtagcctggctccatcttgccctgtgccacaaatgcccatgaccccctgtgccgcgttggagtctgtgttggggaccacacgaggaggtggtcctaccctgccctcgggggtgcacagcccaggggcagagagacccagccgtgccacacgctacccagggtgggagcccaggatggggaggagcacacagtggcaacctcacgctgcctgagggctgctgctgccttcggtgtcccct

SEQ ID NO: 323981 - DNA, 4136 bp, Homo sapiens
tcgtggtggaggaaaggcagatggttagctagtgacgactttattataatgctaattcaggagtatctgggtctctagtgctgaggaaaactgaattttcatgcaaagggcatctatattttcacatctgtatctttatccatctagcttggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323982 - DNA, 3982 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323983 - DNA, 4118 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaacaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323984 - DNA, 3234 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggccctgctggaggagatcgagcgccacggcaagaaggtcgaggagtgccagaggtttgcgaaacagtacacctgccggtggagtacaacctg

SEQ ID NO: 323985 - DNA, 1786 bp, Homo sapiens
tggtgggactcctccatgtccgctccttcaccccccaccagcaagctcacatcctaactccatcatgaccatcttggaggccagcggcaagcaggagccagaggccaaggaggcgcctgcggggcccttggaggaggatgatctggagcccctgaccttggcccaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323986 - DNA, 1556 bp, Homo sapiens
tgagccacagaggagtggcccgcaggaggacagcccagccagggctgggagctggagcaggcccatgtctggaggagctgcagggagatgccaagatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323987 - DNA, 1658 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323988 - DNA, 985 bp, Homo sapiens
  misc_feature (933)..(933): n is a, c, g, or t
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacggaagatggcgcggcggcgcggcggagtgtaggaagaggcactgctgagngcgcgcgaggggaacgaggccagagctgcgtctgctgatggagggaccgctc

SEQ ID NO: 323989 - DNA, 827 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcggtgagcgggaggcggcgtttgggcccggagacgaaaggaggaggctcctaaagaagcaggggctcgggcggggagggcatcgccgtggggagaggggaacagtggctttcgcgacccatgtttcttcccttgctcaggacccttccttggctccctagtgccctcgaggcaaagttccaacgtggccccccgggcgccaccgccccgcagacctcgcttgcttcgactcggcctctttgctttttcccccacctctaacagccgccctggcctttcggttccttaaacttgccatgcgctttcccgcttcggggattttgcacaggctgtcccttccctgccctccatccagaaatccgcctgttaaatgcttttgtcggtccgtgttccttcatgtcacgtgtggtctaatttgttatccgactcttatctgtgtgctgttttatgatgtctatgaccgtgtgttccatgaaggtagggactaggtttgtctctgtcgccactgtgttctcagcacagcgccaatcacgccggagacgcccagctaatgttcgttgaaggaataaaagatactcctagagccagtttggggaaacagggtagtcatcagattcctaggtagcagtggggcagg

SEQ ID NO: 323990 - DNA, 222 bp, Homo sapiens
cagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggtgagtcctcttctgggtgctagggcaggacaggagccctaccctgaaggtctggttctcagctcgtgtgcgtg

SEQ ID NO: 323991 - DNA, 566 bp, Homo sapiens
agcagaaggctccagccactttttggaagcctgtagcctggctccatcttgccctgtgccacaaatgcccatgaccccctgtgccgcgttggagtctgtgttggggaccacacgaggaggtggtcctaccctgccctcgggggtgcacagcccaggggcagagagacccagccgtgccacacgctacccagggtgggagcccaggatggggaggagcacacagtggcaacctcacgctgcctgagggctgctgctgccttcggtgtcccctttttatgttgtcagtcgcttcccctgttccagccctgaaagcagagggcacctcatctttgctcgcagctcccccgatctggggaactcagacccatctcttcacttatgcgtccgcactgtcttcccccacccttcctcccgcctgctgcaggtgagggaaactcagccttgtccccgctgaaccctggagagctcctgatcgcattacacaacattgactccgtgaagtgcgacatgaaatccatcatcaaaggtgaggcgcttcccccccactccagtggcctggcccctgc

SEQ ID NO: 323992 - DNA, 4293 bp, Homo sapiens
gagagaggggacacacggagacctgcaaggtggctgttgcacgttcatgtggcccatcgttcagcagctgtttgtggttggcccacttgaggctgagacttctggctctgccttgggagatgtcagtctcccccaagttacaggccccgtgcacatatccataagccagagacagaccctggaggggagagggacttgagaaggcctgactggggaggaacagcctgggaaggaggcttgggccctttgtaggtgttcgggtgacaatccagcccagcccatccgctggttccctgagcttgatccatcctcttctttcctggggacaagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323993 - DNA, 3797 bp, Homo sapiens
ccccaatctccttccaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323994 - DNA, 4094 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggatcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323995 - DNA, 3240 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccggtgaggcccctgagcccaccaggccctgcccacccacgggcaaggctgtgtccccagctccagctcttccccaacctgctccacctcagagtgtgccaagcccgaagggtggtcaccccgggccgacccaggctgtgtagcttgcaggcggtccgcatgtcactcctgaggaaacgtcaagtggcccggcagttaggagcttggagctgatagacctgggttcgcgttcacttctcgctttctcactgcgaccttgggcccgtcagtaaaaatggggaagacgttccagtccctccacgctgatgcaaggagtccatgaactcaggcacataaacctctgtgttactgtcactttatgagctggccttcctggtgttgctaacgggactctttagctgtcattacataaacataagtccttcctgcccctctctctagaggcacagggctgcccacatgagaagcagctcagtgacagactagcacttgagattaaaaggtctgctcttccagtttgcaaaaaaaaagtcgacgcggccgcgaat

SEQ ID NO: 323996 - DNA, 1483 bp, Homo sapiens
tcatccctgtctctgcctctagatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaag

SEQ ID NO: 323997 - DNA, 2607 bp, Homo sapiens
gaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggtgagggggctgaccctgcaccctcctgtccccaagaggcttcctctcctggtgctgccctccctttctgattgcgaccacctccctcttcgtcaccccccgagtcagtcctcctcgcacccatcccaagtctcctctcctcctccccctctggaggcacgttcaaggttgtagttttgcatgtgggctccaggtcgcactccctgagctgttcctcagctctgccacttgctctgagcttgctctgcgtggctttgtcactccctctctctgccattttcccatctgtaaataacagtgctcacccatgggcctggagatagacttctctacaccccattcactacctgagttggttctgtagcttcctccctatccgtggcctccagcttactcgtctatcctccacacagcagc

SEQ ID NO: 323998 - DNA, 291 bp, Homo sapiens
agcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtgaggatgggtggggagcgttttccccctgggcaggaaggaaggatctcctcggtctttcacctgcctccacttcacaccatccacctcctccagagtaccctcctaattaataaagaaaaggggtttaattggc

SEQ ID NO: 323999 - DNA, 367 bp, Homo sapiens
ctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtaacccatccccggccaccccgcctccaggctgcagacagcagcttctagcctgcttgccctccccttcccccgtctgaccccggagggagcccggtggaggacagcaggctctgctctgcctcctgccaagaaaatagcagtgctccagggtgtatgactgggccagctcccaggtgatgagggagggca

SEQ ID NO: 324000 - DNA, 728 bp, Homo sapiens
ggcacgagggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccccctctccccaatttcattaaagatttcatgaaacattacccctgaaaaaaaa

SEQ ID NO: 324001 - DNA, 386 bp, Homo sapiens
aaaaaggaagagaattgctcctagtccctggggtgtctgtgctgggtccagcgcccacccaagcacagggtggagtgggaggaggtggaggagaggaggggtgccagaggggatgctgagggagatagtgtggggcccttgaggtcttcatgtctatcctctacttccatcctttctcccgggacctccactccaaactctcccccctggacccccaggtgaccatggaggaagaagatgagtctcgagggaagacagaggagtcgggggaggatcggggcgatggtccgccagacagagaccccacgctttctccttctgcctttatcctgcgagccatccagcagctctggacttgttctggtcagatctgccgggatcctcta

SEQ ID NO: 324002 - DNA, 3318 bp, Homo sapiens
  misc_feature (1382)..(1382): n is a, c, g, or t
tgaaatcccggcaagctcggcggcgctttagctccgcctctctcctcctttgctcacgaaccccgccccagcccgccccgccccgcgccggggccggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctncaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccagccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccatgccctggaatctgccagctggtgtggactgcaccaccagcggcgtcctggccttgactgcacttctcttcaagatggaagaagccaacctggcgagccgagcgaaggcccaggagctgatccaggccaccaaccagatctcagcacagaaaagcacctcagtctggggatgacccagttccggggccactctggggggtgggcccgggcccccaaaccggtcgggaggcccctcggggggctgcggtggaccccaaacccacgcgtgcggcaccgtgaacacaaagaggaagccgccttgaggccgggggaaccaaatgatctgagaaaggaacggaaggaggcaggaggaaagacgggacaacgacacatatagaaaggacaccgaggagcgacacccacggccaccaacccaacaggaggaaccccagccagcggcgaccccgaacacgacggaccgacccccaccaagcgagagcaacacgtaatcaacacgagcagctagacc

SEQ ID NO: 324003 - DNA, 444 bp, Homo sapiens
ggatgggagacggggaggaggtcagtctgggaggtgaggagggtgacaggattttctcaaggccacctgggcctgttccgctggccctggggcacccatcgtctagggggacagagggactttggcctggttattggggaagctcctcctaccgcagttccaagctgcgcccaacagtcctgggtggatggggccccgggagcctggtggtgactccaactgtccccggccccccagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagct

SEQ ID NO: 324004 - DNA, 4321 bp, Homo sapiens
  misc_feature (1382)..(1382): n is a, c, g, or t
tgaaatcccggcaagctcggcggcgctttagctccgcctctctcctcctttgctcacgaaccccgccccagcccgccccgccccgcgccggggccggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctncaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccagccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcaggccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgctgcccccgcccatgccctggaatctgccagctggtgtggactgcaccaccagcggcgtcctggccttgactgcacttctcttcaagatggaagaagccaacctggcgagccgagcgaaggcccaggagctgatccaggccaccaaccagatcctcagccacagaaagccaccctcaagtctggggatgaccccagctcctgtgcccacctctttgggtctgccccctggcccctccagctacctgcttcctggcagcctccctctggggggctgcggttcgaccccccccacccccaccgggctggctgccacgtctgacaagagagagggcagcagcagctctgagggccgtggggacacagataagtatctgaagaagctgcacacgcaggagcgggcggtggaggaggtgaagctggccatcaagccatactatcagaagaaggacatcaccaaggaggagtacaaggacatcctgaggaaggccgtccacaagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgtccacctcccttgcccccaagcctgtccccagtgcccctcccttctgtttgtgcccctctccccaatttcattaaagatttcatgaaacattacccctgaaaaaaaa

SEQ ID NO: 324005 - DNA, 4421 bp, Homo sapiens
  misc_feature (1482)..(1482): n is a, c, g, or t
aaaaaggaagagaattgctcctagtccctggggtgtctgtgctgggtccagcgcccacccaagcacagggtggagtgggaggaggtggaggagaggaggggtgccagaggggatgctgagggagatagtgtggggcccttgaggtcttcatgtctatcctctacttccatcctttctcccgggacctccactccaaactctcccccctggacccccaggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctncaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccagccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcaggccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgctgcccccgcccatgccctggaatctgccagctggtgtggactgcaccaccagcggcgtcctggccttgactgcacttctcttcaagatggaagaagccaacctggcgagccgagcgaaggcccaggagctgatccaggccaccaaccagatcctcagccacagaaagccaccctcaagtctggggatgaccccagctcctgtgcccacctctttgggtctgccccctggcccctccagctacctgcttcctggcagcctccctctggggggctgcggttcgaccccccccacccccaccgggctggctgccacgtctgacaagagagagggcagcagcagctctgagggccgtggggacacagataagtatctgaagaagctgcacacgcaggagcgggcggtggaggaggtgaagctggccatcaagccatactatcagaagaaggacatcaccaaggaggagtacaaggacatcctgaggaaggccgtccacaagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgtccacctcccttgcccccaagcctgtccccagtgcccctcccttctgtttgtgcccctctccccaatttcattaaagatttcatgaaacattacccctgaaaaaaaa

SEQ ID NO: 324006 - DNA, 940 bp, Homo sapiens
tgaaatcccggcaagctcggcggcgctttagctccgcctctctcctcctttgctcacgaaccccgccccagcccgccccgccccgcgccggggccggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgacccctgccctgccctgccccgtgtccacctcccttgcccccaagcctgtccccagtgcccctcccttctgtttgtgcccctctccccaatttcattaaagatttcatgaaacattacccctgaaaaaaaa

SEQ ID NO: 324007 - DNA, 127 bp, Homo sapiens
ctcctgctctgacccgaaggtgacctgagcctaaattcctttccaagttccgggccctctgcagtttgcagagtggctccagagcagaccccctggggagtccctggtggtggcaggtcaggattta

SEQ ID NO: 324008 - DNA, 502 bp, Homo sapiens
ctgtttgctgttacaaacaccaattccccctggagttgatgagagttcagtgactgtatccaaggggtcgaaatttgataggttccaaacaacagacacatcagtcaacagcaggagatttcaatgaagggttgtagggagaagaattaggaaatgcctgctggattcggtatccttcggagggatgagacagcaggggggcattattacttaaatgccccccactccagtgggggctgggcctctggtgatgatggactggtgggtgtacacctgactgtagccgtggtacccaggctccataaggaccctttccagaaagctgagtcaattttttcttctttaatgatttaattctgacaaggatgtattgcccagtgcatttcatctataaactttgaacaatgacaaacagccactgtcgactgaaccactggttcaccctggatctgaaagacttttctgctgccttttctgagggagtaggacctgtgaccccgcc

SEQ ID NO: 324009 - DNA, 757 bp, Homo sapiens
gaataattctgccttcggaccagaggaagagagcaagagttagagacagcttcctggaagaggtggcatttgagctagctctttaagtttcaatgggagaagaaagaaaaggcatctggaaacaaggaagcagcagtagcaaatgaggaagaatcagaagggaagccagagagcaccattatcaccagaggatataccaaatccagtcattcataagctatttattttgtgtgattttaaacaatagctgctatcggctgggcacggtggttcacgcctgtaatcctggcactttgggaggccgaggtgggaggatcacctgaggtcaggagttcaaggccagcctggccaacatggtgaaaccctgtctctactaaaaatacaaaataaaaattagccaggcgtggtgtcgtgcacctgtaatcccagctatttgggaggctgaggcacaagaatcgcttgaacttggaaggtggaggttgcagtaagccaagattgcaccactgtactccagcttgggcaatagaacaagactctgtctcaaaaaaaaaaaaaattaaaaaaaatagctgttaccttctccttaaaattaatttaagttgaaggcaggattatgtcttacccagctgcactacaatgcttttacagagaaggttcctaaattttaatttagtacatatattttttcattctagtttaagttacctgaattagcaatgcactgtgctccataactttatggcatttttatccataa

SEQ ID NO: 324010 - DNA, 335 bp, Homo sapiens
cagaagaagccctgtggtatctgagccctttagggccctggggcctggcacagcgctggtgctcaggaactgtgggcaggatcagggagggaggcatctagaagtctctcagggtaaggaccacaaggggttgagaccagagacccagactgatgcccacaaggacagtccctctgatagcccacccaccaccatccatgtgccacaggtcagtgtgccagccagagaagatgccaggctagaggcacggaaggatctgaatacagccccctatattcccagctggctagaacagataccaaggcagcagaactgccagcttcatcttatgggac

SEQ ID NO: 324011 - DNA, 2362 bp, Homo sapiens
  misc_feature (4)..(4): n is a, c, g, or t
  misc_feature (7)..(7): n is a, c, g, or t
  misc_feature (2359)..(2362): n is a, c, g, or t
ggcncangcgcgctggcccggcacggcggtggtcttgcgggaggcgtgggctgggattgcggtgcctgtgcttcccggtgccagggtgtcatggaagggctgctgacaagatgcagagcattgcccgccctggccacctgcagccgccagctctctgggtatgttccttgcaggtttcaccactgtgccccaagaagagggcggcgcctgctgctgtctcgtgtgttccagccacagaaccttcgggaagaccgggtgctctccctgcaggacaaatctgatgacctgacctgtaagagccagcggctgatgctgcaggtgggcctgatctacccagcaagccccggctgttaccacctcctgccatataccgtccgtgccatggagaagctcgtgcgagtgatagaccaggagatgcaggccatcgggggccagaaagtcaacatgcccagcctcagcccggcagagctctggcaagccaccaaccggtgggacttgatgggcaaagagctgctaagacttagagacaggcatggcaaggaatactgcttaggaccaactcacgaggaagccattacggccttaattgcctcccagaagaaactgtcctacaagcagcttcccttcctgctgtaccaagtgacaaggaagtttcgggatgagcccaggccccgctttggtcttctccgtggccgagagttttacatgaaggatatgtacacctttgactcctccccagaggctgcccagcagacctacagcctggtgtgtgatgcctactgcagcctgttcaacaagctagggctgccatttgtcaaggtccaggccgatgtgggcaccatcgggggcacagtgtctcatgagttccagctcccagtggatattggagaggaccggcttgccatctgtccccgctgcagcttctcagccaacatggagacactagacttgtcacaaatgaactgccctgcttgccagggcccattgactaaaaccaaaggcattgaggtggggcacacattttacctgggtaccaagtactcatccattttcaatgcccagtttaccaatgtctgtggcaaaccaaccctggctgaaatggggtgctatggcttgggtgtgacacggatcttggctgctgccattgaagtcctctctacagaagactgtgtccgctggcccagcctactggccccttaccaagcctgcctcatcccccctaagaagggcagtaaggagcaggcggcctccgagctcatagggcagctgtacgaccacatcacagaggcagtgcctcagcttcacggggaggtgctcctggacgacaggacccatctgaccatcggaaacagactgaaagatgccaacaagtttggctacccctttgtgataatcgctggcaagagggccctggaggaccctgcacattttgaggtttggtgtcagaacactggtgaggtggccttcctcaccaaagatggagtcatggatttactgaccccagtgcagactgtctaaatgcccccagcccacccctgcccccatttgcagccttggtgttcgttctaacactgcattttcctacacccctttcctggactgctctctccagaaacagcacagctcatggagggtgagatcatgttagggaaatcaatttttatctagtcatttgttcagattatttgtatttaaagtcattaacttgatccctttctccagactggccatgccgccatatacctttccttttgtattccattgtggaagcttctaggaggctgagaagcaggagatccaagctccagtcctgggtgttaccctgaggggggaagtcacttcccttctctcagctgagtttttcacgtgtaagatgagaatggctgatggctgagagcccaccaaccttccccaccccgtatcagtttgaccacgggccttttgctacattctatccagagagcaggcctgccagcccctctccactgagaagttgggctgagagtatggggaaaagaatcaagagacctgactgccgccaactcactagtgacttagatacatcccctccccctgctggggcctcagtttccccatctgtaacttgagaaaatagaactagatctgtaaagtctggaactagatctgtaacgtccttataggtgtcactagggggttccatgagaggtgtgtgacaggcagtctgattcctctcattctccatagtctgtttcctggaaagtcgatgtaattaactgatggcccaaaaactacctcaagagacctggccctgttaagacggcttaaccactgagatcccgttctattgatttaataaagtcaaactattggaaaaaannnn

SEQ ID NO: 324012 - DNA, 185 bp, Homo sapiens
tagcagcatttcttcctatcactttcagattataataaagcaatcaataagacattcattctcttcatacacagcctaataatcctggtgaccaactatacccagcagggaggacaaagctcttaacacgaaagagtgaggagaatctctccattacccttttacatattcagggaagagagaat

SEQ ID NO: 324013 - DNA, 400 bp, Homo sapiens
gccaaaagttaatcctttgccaagattttaaaaatggacaaacttttactaagactgatcaagaaagagaagtcagacataaataatattcaacatgagaaaaggggaacacatatacaaataaaacagagattaaaaagagaattaatgccataccacgagcggtggctcacacctgtaatcctagcactttgggaggccgaggtgggcagaccacttgaggtcaggagtttgtgaagagcctggccaacatggtgaaactccgtctctactaaaaatacaaaaaaatcagccaagcatggtggcgcacggctgtaatcccagctactcaggaggctgaggcaggagaatcgcttgaactcaggaggcagaggttgcaatgagatggcaccactgcact

SEQ ID NO: 324014 - DNA, 258 bp, Homo sapiens
tcttccaattaggttacttttctttaataaagttatgctgccttcagttttccaatggcaagtagacaggatatgttcaaggttttctgcactgtaggcacagtctctcaagcatatcagtgcagtggcacaatctcagctcattgcaacctctgcctcctgggttcaagtgattctgctgcctcagcctcctgagtggttgggattacaggcatccaccaccaggcccagctaattttttgtattcttcagtagaga

SEQ ID NO: 324015 - DNA, 1766 bp, Homo sapiens
tcttccaattaggttacttttctttaataaagttatgctgccttcagttttccaatggcaagtagacaggatatgttcaaggttttctgcactgtaggcacagtctctcaagcatatcctgatcatgtaatgactgcataaactccatcaacctaaggtgatacttgtaaataatttatttttaagggatggtgactttaaaaattattaatgaactttgagaagttttaagagtgcttttaaaacttcacagtattgccaattatcttaggttattcagtattcaggtttgtgtttctctgttttaaactaaaatgtgttttctgaagaaaaaaataatagtttacacaaatgtacaatcatagaataagcattttaagctggcgactagtgttctatagattacaaagcaagaaaactttctatgaagataaatgaccttttgcctgaagagtacagataaaatcaaagatgtgtgcaagctagtttttggaagaagtgatgcttctcttctttaaagagacagtcaccaaatacttggtttaactcgactattgacttgggcattgagagagatgatatatacatctttggaaagtgaagtcaatgttcaagaggtgatagaagctttactttttagtgatcagaaatatttagtgcatcttttcagacaggaagaattttatcatcaagtattcccttataaaaccaagtaacacttctttatcagtaacttttagaacttaaaagaaagcaaaaagtaaatggaattgtaggcaatttatgaatcctagtagattttacaatatgtaatttatgttgtttacagtatataaacactaagttttgtgttaaatgtgatcaggaataaaagtatcccacaggcatctgacacaaattccagaattagccaaagaattgtttatttgaggccaggcaatcccagcattttgggaagccaagttgggctgatctcgaactcctgacctcaggtgatccacctgcctcagcctcccaaagcgctgggattacaggcatgagccatcacacccagcgaaaagtttgtttgaataaacaatatccgaaagacaattagtttcttcagatgtattttgaaattctcctaaagagctagtgtttctattcattttcacaatttaaaaacagctcttaacattgctgaagttgggagaactttccatctcttcttaataacagtgcaagattttgtaaattcttttttgtgtttaatgtttaataaaacgagtattaagcttaaattactgaagtacctgggagaagtaatgatgtgtactttcaaaaaaatggaaaatgcttttattttattttctataatttgttaacatgatatgtaaaattaaacttcggagcacaatgaaatgccgattatttttaccttgtttgggcttaaagtaggtatttaaggtttatgtgttcaaaatgccttggtaaattggatgacctctaactttactgtccatatggagtttgtcattctttatggataagagaacttaaggaaaagttactgtttttcttcagtctttttatatctatctgatttaaaatctgttactttattaaaaggcttcaacaacaggttgttaggatgtagtcttacatccaggttcacataataaccccatttgaatccaaatttgtgtatattttcttatgccagcagtatttgtatccaattttaacttaggtttgttttcttgagtattaaaatttaaacatatata

SEQ ID NO: 324016 - DNA, 1567 bp, Homo sapiens
tcttccaattaggttacttttctttaataaagttatgctgccttcagttttccaatggcaagtagacaggatatgttcaaggttttctgcactgtaggcacagtctctcaagcatatcctgatcatgtaatgactgcataaactccatcaacctaaggtgatacttgtaaataatttatttttaagggatggtgactttaaaaattattaatgaactttgagaagttttaagagtgcttttaaaacttcacagtattgccaattatcttaggttattcagtattcaggtttgtgtttctctgttttaaactaaaatgtgttttctgaagaaaaaaataatagtttacacaaatgtacaatcatagaataagcattttaagctggcgactagtgttctatagattacaaagcaagaaaactttctatgaagataaatgaccttttgcctgaagagtacagataaaatcaaagatgtgtgcaagctagtttttggaagaagtgatgcttctcttctttaaagagacagtcaccaaatacttggtttaactcgactattgacttgggcattgagagagatgatatatacatctttggaaagtgaagtcaatgttcaagaggtgatagaagctttactttttagtgatcagaaatatttagtgcatcttttcagacaggaagaattttatcatcaagtattcccttataaaaccaagtaacacttctttatcagtaacttttagaacttaaaagaaagcaaaaagtaaatggaattgtaggcaatttatgaatcctagtagattttacaatatgtaatttatgttgtttacagtatataaacactaagttttgtgttaaatgtgatcaggaataaaagtatcccacaggcatctgacacaaattccagaattagccaaagaattgtttatttgaggccaggcaatcccagcattttgggaagccaagttgggcagatcacgaagtcaggagttcgaaatcagcctgaccaacatggtgaaacctcttctctactaaaaatacaaaattagccgggcatggtggcacatgcctataatctcagctactcaggaggctgaggcaggaggatcgcttgaacccgggaggcagaggttgcagtgagccaagattgcgccactgcactccagcctgggcaacagagtgagactctgtctcaaaaaaaaaaaaaaagaaaaagaaaagaaaaaggtttatttgaataattggaagtcagtttatacattactatttttcagcagtagggaatttctccaattacattcatgttgaatgaatttttatttatatatagcttacccttccaaaataaaagtgtttttttaatgttgttttgttttgttttgtttttttccttttttgagacggagtttcactcttgttgcccagactggagtgcagtggcacaatctcagctcattgcaacctctgcctcctgggttcaagtgattctgctgcctcagcctcctgagtggttgggattacaggcatccaccaccaggcccagctaattttttgtattcttcagtagaga

SEQ ID NO: 324017 - DNA, 699 bp, Homo sapiens
gaatattggctgtggcataacaggctgccaatagcgtttttgtgaggaaattgtggcattttggaaatgatcctagagaatctacagaggtgggcaaacgtaaacacttgtacagtgctttcagtaggctttttattgccccagtgcccttgtgccctcgatgtgacatgccacaagtgaaggagaagtggtgaggggattatttgaggaaagctttgttggacagtttggatgcatcatcgggagatactgccaatttacaggaagtactgtataaagagttctctctttgtgtcttaattttataagatttcctcttctcttgcaggtagccctaatacagtggtttttcttatgacttatttttcttgagggtgtacttcgtttctcaccagtcaaaaacatagaagttctgcaactcagaatggaaattcacttgaagtaatgtgtgattcctctgtaatcagtgccattaatagcaaaaaatatttaaaaggaagatgattgggacctaatagtctataaacaaattgagtaagaaagcattaagaaggactagtaatgtattctgccttgtttctttcaaatgaagactgttaaactgagttacggggaagaaaaagtgaataccctattgtttcaaggtaataaagaataaacagtatacttccttttggttagtgttttccagaatttact

SEQ ID NO: 324018 - DNA, 3985 bp, Homo sapiens
  misc_feature (2373)..(2373): n is a, c, g, or t
  misc_feature (2419)..(2419): n is a, c, g, or t
tttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttataggttttgtggctattttaaattgtaaagcataatcctataaacattaaaactcaagagcttttcttctttcatgtcttgtaaattaacactgtagcagcattcagagaaaatagattcagagctcaacttttcacataaataaatctaacagtgtaatatataaacctgaaaaatgtcagttgagggaggtctttattctagattggcatttttttttttttaaattaggtacaaattatgagtgtaaggaattgggtttcctgctctcctgtctttccatctttttggttccccaagctaattgattgggtttatttatgagcctgttacagtaaagtgtgtgttgggaaatatattgaggtatagagctattctttgtaggtaccctggtgagaccgatacaaatatgcccctccccataatggaatactaattttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaatgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtaagaacttttttttcctatttttttttttatcagtagtggggcattaagtgtgggagaatgcccatatcctataagtgggcaattatgtcagccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctnttggagagacaataaatttgctttaactgtcatttcagtctagtantatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcagtttgacaataatggcctcaatttagagatatgttgagacaatgactttgggtcaagaggaaattacatagctgaaatattaagaccttgaacatagcagaaacataaacctatgaacaacttgtgttttgtgtgaaagctagggtagctgataggattagcagatattggtagaattaagagtcaatatttaaattattgctaaagattaaaatccctcatcttatagtttgtaggggattccatgatggtaaggtatagattgaaattaaatttagtaactaggcatttctgaccataccatataaaaaataattgtaatatggtataaacactgattaaaagtaattatggattttcatgcctgaagaaccttctcagtattcttacagcactgtatcttctttattggttgagaatatcagtctagaaagactttcctagatgttaaatgtgctagtcagtgtcatgaatataaacccttacttgtaagtttgctatagactagttgtacaacactagaatgaaattatgtaatacttttaagaattgtagtgattgcagggttgtgttaaggtaacattttatgcatgtgtcagtgacagaaaggatcagggtataaaacttagcactaaatagcatgctccttaggaagttttaaggtaagcagtaggaatattcatgtaattctgatgagtttatgtaagttaaggaaaatgcaatgccagtttgttgactttaaacactaaaaacaaaatacattttgtggaaccaacaaaggagacattctggggaaaaacttaaattgctcaaatttaaataagggctctcactttatatagtagatttgtcaggatcccatgaacattgcttttcttgatttctcacatatgagggttgggcaaaagggacttctctagcctcttcgataatgtaggtagacttgtacttagtgaatcccattataatgttaggtactatgttctaagactatttctataattggactgaaggctcctgcaaacataaattgctgatatggatatagtaacataagaaataccaaaatagggacatttgcaagaccttttccatttaatcatcagtttaataaaaatcatgcttttggtacagtgttcatgtaccataactgtattggaatatttgtacgatgttaaatatttttaataaaatttaacatgttcaaaatgttgtgttggtgattttgggtggggtgtgatgggtttgattgtgcaaaacagatttagtagttatgtgatttaggcttttgtagttaaatggagtttctgtcttcaaatttagtactagatactgtacctgttctaaggaaggtagtgaaggagtaggatagtaaa

SEQ ID NO: 324019 - DNA, 2465 bp, Homo sapiens
tttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttataggttttgtggctattttaaattgtaaagcataatcctataaacattaaaactcaagagcttttcttctttcatgtcttgtaaattaacactgtagcagcattcagagaaaatagattcagagctcaacttttcacataaataaatctaacagtgtaatatataaacctgaaaaatgtcagttgagggaggtctttattctagattggcatttttttttttttaaattaggtacaaattatgagtgtaaggaattgggtttcctgctctcctgtctttccatctttttggttccccaagctaattgattgggtttatttatgagcctgttacagtaaagtgtgtgttgggaaatatattgaggtatagagctattctttgtaggtaccctggtgagaccgatacaaatatgcccctccccataatggaatactaattttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaatgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtagccctaatacagtggtttttcttatgacttatttttcttgagggtgtacttcgtttctcaccagtcaaaaacatagaagttctgcaactcagaatggaaattcacttgaagtaatgtgtgattcctctgtaatcagtgccattaatagcaaaaaatatttaaaaggaagatgattgggacctaatagtctataaacaaattgagtaagaaagcattaagaaggactagtaatgtattctgccttgtttctttcaaatgaagactgttaaactgagttacggggaagaaaaagtgaataccctattgtttcaaggtaataaagaataaacagtatacttccttttggttagtgttttccagaatttact

SEQ ID NO: 324020 - DNA, 2129 bp, Homo sapiens
tttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttataggttttgtggctattttaaattgtaaagcataatcctataaacattaaaactcaagagcttttcttctttcatgtcttgtaaattaacactgtagcagcattcagagaaaatagattcagagctcaacttttcacataaataaatctaacagtgtaatatataaacctgaaaaatgtcagttgagggaggtctttattctagattggcatttttttttttttaaattaggtacaaattatgagtgtaaggaattgggtttcctgctctcctgtctttccatctttttggttccccaagctaattgattgggtttatttatgagcctgttacagtaaagtgtgtgttgggaaatatattgaggtatagagctattctttgtaggtaccctggtgagaccgatacaaatatgcccctccccataatggaatactaattttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaatgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgactcaggtggtgtggctcaggtggtgtgactcaggtggtgtgactcaggtggtgtgactcaggtggtgggactcaggtggtg

SEQ ID NO: 324021 - DNA, 870 bp, Homo sapiens
tctcagcctcccaaagtgctgggattacaggtgtgagccactgctcccagccgggtgtgatatttttaataaaacaagtattcaaattcacttacaggaccaatgaaagaatcgtttgtcgtaattttatgccaaagggtacttgtggcttaagataaacttcccataatgacattatccacagattcaaaaagtagtttatcttaaacaacttctgtgacattttaaaatgatgtggcttagaaaattgctaggttatctaaaatggctctattgatgatgtaaatgtagcacatgaagagcttgaataaaatagacttttgaagtgtgcaaatggaaagaacagtccttctaaataattatttcccctcccttttattgacgtatacatacagaaaagatatcatgtcgtaagtgtattgcttagtgaattactccaaagttggatatacctggttaaccaccacctgaatgaaaaaaacagaacactgcttcatatggagaagcccctcctgcccctcctggtcattgtcctttccatccctcccacaggtagtcactgagttctaataccacagagtcttttgactttcttttgagccttatgtaattagaatcacaaaagatgtattcttttgcctgacttttatacttagtattgtttttgaaattcatcttgtgtgtaactgcgatttgttcattttcattgcttagtgaattattccaaagttggatatacctggttaaccaccacccgaatgaaaaaaacagtttttggcgtgagccactgtgccccactgttcaagttttcattgattgctgcctacatatagttgttcaacagctattgattccccctgccctgtgaaa

SEQ ID NO: 324022 - DNA, 516 bp, Homo sapiens
tctcagcctcccaaagtgctgggattacaggtgtgagccactgctcccagccgggtgtgatatttttaataaaacaagtattcaaattcacttacaggaccaatgaaagaatcgtttgtcgtaattttatgccaaagggtacttgtggcttaagataaacttcccataatgacattatccacagattcaaaaagtagtttatcttaaacaacttctgtgacattttaaaatgatgtggcttagaaaattgctaggttatctaaaatggctctattgatgatgtaaatgtagcacatgaagagcttgaataaaatagacttttgaagtgtgcaaatggaaagaacagtccttctaaataattatttcccctcccttttattgacgtatacatacagaaaagatatcatgtcgtaagtgtattgcttagtgaattactccaaagttggatatacctggttaaccaccacctgaatgaaaaaaacatgacaccgtcgaaggggatcctatagagtctgc

SEQ ID NO: 324023 - DNA, 514 bp, Homo sapiens
tgaactcctgacttcaggtgatccacccatctcagcctcccaaagtgctgggattacaggtgtgagccactgctcccagccgggtgtgatatttttaataaaacaagtattcaaattcacttacaggaccaatgaaagaatcgtttgtcgtaattttatgccaaagggtacttgtggcttaagataaacttcccataatgacattatccacagattcaaaaagtagtttatcttaaacaacttctgtgacattttaaaatgatgtggcttagaaaattgctaggttatctaaaatggctctattgatgatgtaaatgtagcacatgaagagcttgaataaaatagacttttgaagtgtgcaaatggaaagaacagtccttctaaataattatttcccctcccttttattgacgtatacatacagaaaagatatcatgtcgtaagtgtattgcttagtgaattactccaaagttggatatacctggttaaccaccacctgaatgaaaaaaacaga

SEQ ID NO: 324024 - DNA, 5382 bp, Homo sapiens
tctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324025 - DNA, 5641 bp, Homo sapiens
tctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggtacatttcttcttacacactaagtctcattatgtaaacattactcaatcagatttttaaaatgcactgtttttattaaattgccctaaattgagctattttaggtaaaacccggactccagatttaaattaccctaataatctcaatttatgagaatttatgaaaaacacaaagctaacatcacactcaatggtaaaagactgaaaactttcccccaagatcagtaacaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324026 - DNA, 4371 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324027 - DNA, 3843 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttaccagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324028 - DNA, 3791 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacagctgtaaggatctttgagatgatttaaataaatcgctgcagagtaattgtcttgtggt

SEQ ID NO: 324029 - DNA, 1878 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggtcagtgtcagagaaaaaggcacttggcttggttggtgagggtttcggatatatcccacacatgcatcagaacactggatttgtgctggcttcagcaacacatatattaaaattggaacgatatagaggagattagcatggccgttaaataaaaaatttt

SEQ ID NO: 324030 - DNA, 1733 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtaaccaatccaagaggtaatagagttgggatgtttagatcaggctcacatctggaaatgacacaagggccagaaaagcagggccatgtctattttgagatcatttcagccacacttttgggtgacctatttagaaacagtgctctataatgcatggaattaaaaatgggctgcacgttaacatttttagctcagaacatgttggtcaagccacatttatcatcattctgtcacagagttgtgattgagggcagcttaggagcat

SEQ ID NO: 324031 - DNA, 375 bp, Homo sapiens
cacaggctggctgaaatcagccgttgcggtggctgtaagatagtatatgtgctcttgcctctgctcgggtgacattagatagcgagcacctgtttgatagctttgaacccgaaacgtactgggatcgaatgcacctcttccaggaagccattgcacacaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324032 - DNA, 207 bp, Homo sapiens
ctcaacatcagctgcttgctcaaggagggcagcgagcacctgtttgatagtaagaaatattcccttctggaggttgtctcaaccagtaagaccccgtccctaacaaggacaccactctgggtatccagtcaacacggactagggaaaagggacagcctttcaacaaggggccaaaaggatcaaggttctaaaggatcctgattcttg

SEQ ID NO: 324033 - DNA, 427 bp, Homo sapiens
tccctcccctggccccccatcccacacttgccatggtgaccacatgtaccttttccccctgttacgtgaggcagttctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggtcagtgtcagagaaaaaggcacttggcttggttggtgagggtttcggatatatcccacacatgcatcagaacactggatttgtgctggcttcagcaacacatatattaaaattggaacgatatagaggagattagcatggccgttaaataaaaaattttaaaaaaaca

SEQ ID NO: 324034 - DNA, 545 bp, Homo sapiens
tattgggttccatgtggcttgggctggtgatgggttttagttttaactcaaggtaggacagcatccctcgcttgatggtaactttttgtctcttgcctggcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgaggtaagagtgctgaagcacagacagagccagggacatctttcttaatatagtgggtgactggaggtgggaggattggtcagaggtggggtgtaaatcccacatcttaatgatttctttgccagtgcagtaggtacaaatcactttagctgttagctatgtatatattatacttcttttttttttttttttttttttggtgacagagcacctaggataaagtg

SEQ ID NO: 324035 - DNA, 305 bp, Homo sapiens
gtacatttcttcttacacactaagtctcattatgtaaacattactcaatcagatttttaaaatgcactgtttttattaaattgccctaaattgagctattttaggtaaaacccggactccagatttaaattaccctaataatctcaatttatgagaatttatgaaaaacacaaagctaacatcacactcaatggtaaaagactgaaaactttcccccaagatcagtaacaaggtaagtatgcttgcttttgccactgatattcaacattatactaactagaagttctagacagaccacctaggca

SEQ ID NO: 324036 - DNA, 4632 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324037 - DNA, 4069 bp, Homo sapiens
tcctttctttacaactatgatcctaggactttggctgcataatgtctgtcatttcccccctctcttatataacatctcaagctgttaagggtgaagtaccgcatacaggtttcccacttgtagatcacactggggatttttgttattgggttccatgtggcttgggctggtgatgggttttagttttaactcaaggtaggacagcatccctcgcttgatggtaactttttgtctcttgcctggcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324038 - DNA, 1318 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324039 - DNA, 3772 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttaccgtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcaaaaaaaa

SEQ ID NO: 324040 - DNA, 1013 bp, Homo sapiens
gacaaaactgaatttctcttctcagcctgaactacatactccgttttctctatttcagatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcagaggttgcagtgaatcaagatcgcaccactgaactccagcctagagacagaacgagattccgtctca

SEQ ID NO: 324041 - DNA, 391 bp, Homo sapiens
tttgactagcccctggcccgaattccccttagttcctggattctgtggttctatttgttctccatcgctccttgtaactggaggagtgacttcttccgagagtcacttggcaccacttcacagcagaggaacaccagtatcttcactggcctaaaatcaaagagtggttgcaaggaaaaatctgacattccaaccttttcgtttgtatttctgtggcagggaggcaagatgacttctctgccccaagcttggaacagctaaagggaaaaacagtgcaagatgagaacaacaaaggtctacaaactcgtcatccacaagaagggctttgggggcagtggtcagtatcgattggtctttagaggttttgtaagttggctgaggttctggtgtg

SEQ ID NO: 324042 - DNA, 739 bp, Homo sapiens
agtgatatatctactctatcaggcagaatgacttagagaaatttctcaaacctgagttaggaaaaaatacatagtggactcctaagtcccttaacatctgctcataaattaagtcaaccattacattgagggattaaaccagggaccagaatatcaaatgtctacacatgtcagccaaagaagagatgcagagggttgggtggggctggaagcagataggaggggtctccagggactataggagtacaatcaacttgagtaatcacctgcttttttccccaaaccctgtgtggaatgcagccagctagctggtttaaaccagttcatgacagacctcagcaatttacagatggatcccagtgtactttcctcattaccatgctagtatcttcaccctgggagatgctatagcttcattaccataacatgtgacctgtgtgctgaaataacgactcactgcatctgcacaactgcaacccctttccatgcaacgacataccctcttccctctctatcaccccataaaaccctcctgtcactttcctgctttggagactatgcccggtgctttatttgtgacaagtaataaaactattgctcaaagcctgcattcttggttggttatagtggctcatgcctataatcccagcactttggaaggctgaggcaggaggattgcttgagcccaggagttcaaaactagcctgggcaacacagacccccttctctataaaaaaga

SEQ ID NO: 324043 - DNA, 1285 bp, Homo sapiens
aaaaaactcctcagtttcttctggtttcaaactttttaaaaaaatattaggacaagtgcagtggctcacacctataatctgttttcatcactgcttcatatttaagttctaagaagttatctgtacttactgtctctacttaatctctcatgtgcttttcaaatgcactgaaatttgggttctgtcttcatcagtccatcaaagtagcttttactaaaatcatcaatgatctccaatccattatctagttttcagttcttatcttacttgtctgcccctggcactgttcttcacagttgtactcgctcctttttgcttccaaattacattttcctcatctggtactgagctccctgttaactttctttactcttggttttagcatttccatttccttgaatgtgccagagctctgtcctctgggtctttgtacaggttgttccttgggcctacaatactcatttccaaacttttcacttaactaagaattgcaggcctcagcattaatgctacctgaagctttctctaatcctcatttaaattagttctgttacaaactttcaagttgccatattctttcataacattaacacaaattttgtaaacatgtatttggtggtttgtctaatttctgtatccatactacgtttaacctctgtgaggacaagggagcatgtttcttgttcagaattataaattagtccagtcatagtccctggcacataatattgaaattagtgaatcgtgtgtatcttcataaacatactgtttgtcctggtagagcaaaaattgtcaacctgggattcatggacaaccaatgatgtgaaaaaaacccagtaatttcctgcaagattctgtgcttttccttggagggaagtccctgaatttcatgggactttcaaaagaactgagacattctgacccccagaaagaaagacccaccacagtgataaaagagttccaaagcttcacctccagctttttactgtctctcccaccgccatgcatctgcacaactgcaacccctttccatgcaacgacataccctcttccctctctatcaccccataaaaccctcctgtcactttcctgctttggagactatgcccggtgctttatttgtgacaagtaataaaactattgctcaaagcctgcattcttggttggttatagtggctcatgcctataatcccagcactttggaaggctgaggcaggaggattgcttgagcccaggagttcaaaactagcctgggcaacacagacccccttctctataaaaaaga

SEQ ID NO: 324044 - DNA, 1125 bp, Homo sapiens
aaaaaactcctcagtttcttctggtttcaaactttttaaaaaaatattaggacaagtgcagtggctcacacctataatctgttttcatcactgcttcatatttaagttctaagaagttatctgtacttactgtctctacttaatctctcatgtgcttttcaaatgcactgaaatttgggttctgtcttcatcagtccatcaaagtagcttttactaaaatcatcaatgatctccaatccattatctagttttcagttcttatcttacttgtctgcccctggcactgttcttcacagttgtactcgctcctttttgcttccaaattacattttcctcatctggtactgagctccctgttaactttctttactcttggttttagcatttccatttccttgaatgtgccagagctctgtcctctgggtctttgtacaggttgttccttgggcctacaatactcatttccaaacttttcacttaactaagaattgcaggcctcagcattaatgctacctgaagctttctctaatcctcatttaaattagttctgttacaaactttcaagttgccatattctttcataacattaacacaaattttgtaaacatgtatttggtggtttgtctaatttctgtatccatactacgtttaacctctgtgaggacaagggagcatgtttcttgttcagaattataaattagtccagtcatagtccctggcacataatattgaaattagtgaatcgtgtgtatcttcataaacatactgtttgtcctggtagagcaaaaattgtcaacctgggattcatggacaaccaatgatgtgaaaaaaacccagtaatttcctgcaagattctgtgcttttccttggagggaagtccctgaatttcatgggactttcaaaagaactgagacattctgacccccagaaagaaagacccaccacagtgataaaagagttccaaagcttcacctccagctttttactgtctctcccaccgccagtatctgtgacactgccgtatcaacatacagcaatctcctaatttgaatataatcaagaacttttccactacctgtttggatggagaaactgattaaaaaaacgtttctagaaagcatacct

SEQ ID NO: 324045 - DNA, 665 bp, Homo sapiens
gagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaatcacatgctcagatcaaagctgtagaggaaactgacataattagactcaggtggtgtg

SEQ ID NO: 324046 - DNA, 431 bp, Homo sapiens
cagtaatcctctctctctctctctctctctctctctgtctctctctatctctgtctcagagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatg

SEQ ID NO: 324047 - DNA, 784 bp, Homo sapiens
gagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaacctcgtgccgaattcggcacgaggagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctccc

SEQ ID NO: 324048 - DNA, 518 bp, Homo sapiens
cagcactgaagcactgcagcccagcccagcagcaaggtatgttgccgtgtactgcttcctagggtgcgggactgcacgccctcagagtctcaccctgaggcccaggccggagtgctgtgacgtgatcttggctcactgcaacctctgcctcccggattcaagcaattctcctgtctcaacctcccaagtaactgggattacaggtatgcgccaccacacacaactaatttttgtattttttagtcgacatggggtttctccattttggcctggctggtctcaaactcctggctgcaagtgatccacctgcctcggcctcccaaagtcctgaaattacaggcgtgagccacccctcccaaactcttttttctttattagtctagctagtggtctatcttactaacttttccaaagaaacaattcctgggttcattgaccttttgtatagttttttgcttctcaatttccttcaattcagctctgatttgggttatttctggtcttctgctagatttggg

SEQ ID NO: 324049 - DNA, 2452 bp, Homo sapiens
agcgggggtttctctcactgcctgccttggtgatcttggttacttaaaggctctaagcttgagttttctcatccatcaaaacacacacctactacttggaagatgaactgttctcatcagcaacatgctattatgtcatcttttaggactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatacattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacctacaaagta

SEQ ID NO: 324050 - DNA, 2636 bp, Homo sapiens
aaggctctttgtcccttcctttgggccgcgtctctgcccctccgcgtctgacagccgcggcgcctcggctcgggcggagagccgagcgtggctggggctgcgcgagtcgagcggggcgggcttggtccggagctgcgggatgtagatcccgggcggcaccgcactcacttctttttctgtttttgacagctcagttctcttctactttgggagagagagaaagtcagatgccccttttaaactccctcttcaaaactcatctcctgggtgactgactacttggaagatgaactgttctcatcagcaacatgctattatgtcatcttttaggactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatacattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacctacaaagta

SEQ ID NO: 324051 - DNA, 1665 bp, Homo sapiens
gcagggaggcggagcggaagccgagtgcgagggacgagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttc

SEQ ID NO: 324052 - DNA, 2482 bp, Homo sapiens
gcagggaggcggagcggaagccgagtgcgagggacgagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatacattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacctacaaagta

SEQ ID NO: 324053 - DNA, 2442 bp, Homo sapiens
aaggctctttgtcccttcctttgggccgcgtctctgcccctccgcgtctgacagccgcggcgcctcggctcgggcggagagccgagcgtggctggggctgcgcgagtcgagcggggcgggcttggtccggagctgcgggatgtagatcccgggcggcaccgcactcacttctttttctgtttttgacagctcagttctcttctactttgggagagagagaaagtcagatgccccttttaaactccctcttcaaaactcatctcctgggtgactgagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactatacttttcaacaaccaagacatcaaagcagtgtcaagttacgtgagcaaatactagacttaagcaaaagatatgttaaagctctagcagaggaaaataagaacacagtggatgtcgagaacggtgcttctatggcaggatatgcggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatagcagttgaaaatcaccttgtgctgctccatccactgtggattatatcctatggcagaaaagctttataattgctggcttaggacagagcaatactttacaataaaagctctacacattttcaaggagtatgctggattcatggaactctaattctgtacataaaaattttaaagttatttgtttgctttcaggcaagtctgttcaatgctgtactatgtccttaaagagaatttggtaatttggttgatgtggtaagcagataggtgagttttgtataaatcttttgtgtttgagatcaagctgaaatgaaaacactgaaaaacatggattcatttctataacacatttatttaagtatataacacgttttttggacaagtgaagaatgtttaatcattctgtcatttgttctcaatagatgtaactgttagactacggctatttgaaaaaatgtgcttattgtactatattttgttattccaattatgagcagagaaaggaaatataatgttgaaaataatgttttgaaatcatgacccaaagaatgtattgatttgcactatccttcagaataactgaaggttaattattgtatatttttaaaaattacacttataagagtataatcttgaaatgggtagcagccactgtccattacctatcgtaaacattggggcaatttaataacagcattaaaatagttgtaaactctaatcttatacttattgaagaataaaagatatttttatgatgagagtaacaataaagtattcatgatttttcacatacatgaatgttcatttaaaagtttaatcctttgagtgtctatgctatcaggaaagcacattatttccatatttgggttaattttgcttttattatattggtctaggaggaagggactttggagaatggaactcttgaggactttagccaggtgtatataataaaggtacttttgtgctgcattaaattgcttggaaaatgttaacattatattatataagagtatcctttatgaaattttgaatttgtataacagatacattagatattcattttatataatggccacttaaaataagaacatttaaaatataaactatgaagattgactatcttttcaggaaaaaagctgtatatagcacagggaaccctaatcttgggtaattctagtataaaacaaattatacttttatttaaatttcccttgtagcaaatctaattgccacatggtgccctatatttcatagtatttattctctatagtaactgcttaagtgcagctagcttctagatttagactatatagaatttagatattgtattgttcgtcattataatatgctaccacatgtagcaataattacaatattttattaaaataaatatgtgaaatattgtttcatgaaagacagatttccaaatctctcttctcttctctgtactgtctacctttatgtgaagaaattaattatatgccattgccaggtagaagtttggaataattgtttagtctctcctattagatgtggacatttttgtttttgtttttgttttcagggatgaaataaaatatattatttctacctacaaagta

SEQ ID NO: 324054 - DNA, 726 bp, Homo sapiens
  misc_feature (706)..(707): n is a, c, g, or t
  misc_feature (718)..(718): n is a, c, g, or t
gcagggaggcggagcggaagccgagtgcgagggacgagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagagagaaagtcagatgccccttttaaactccctcttcaaaactcatctcctgggtgactggactaggtaatgctccagtgacttaataccaatgacattttcatgttgtccacaaattctgagtagaaaccttttcaagcctgtagcctctctgagagctgactgttattaactgaatgagaggatgtcagcaaacagagttaatagagtggatacaaccttgctgaagatgaagaatatacaatattgaggatatttttttcttttttttttcaagtcttgatttgtggcttacctcaagttaccatttttcagtcaagtctgtttgtttgcttcttcagaaatgttttttacaatctcaagaaaaaatatgtcccagaaattgagtttactgttgcttgtatttggactcatttggggattgatgttactgcactccagcctgggtgacnngagtgagactntgtctcag

SEQ ID NO: 324055 - DNA, 253 bp, Homo sapiens
agctgacagaacaagaggaggtcgagttgatgagaagagagagagagagagagagcactgtaatcaaggagaaccaactgaagctggagggaagcagaaagaatagccaggctggttcaggaggcagttctggtacctctgaccccattgcccacccccagtaggcagcatgaaatatgccagaggtcaacaattttttttttgggtatttttaagacagagtctcactctgtcacccaggctggagtgcagt

SEQ ID NO: 324056 - DNA, 245 bp, Homo sapiens
agaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaa

SEQ ID NO: 324057 - DNA, 490 bp, Homo sapiens
gtggtatttaacatgaaaatttaggaaaaaataacagacttagattcctcatgctcaggaatatgggccttcaagaccctgaaaatactagaaggagccaaaggaatttttgcctagaggcaccaaacaagttcaatcagaaaaaccacaaacaattaggcacctctcagctccaggaagactcggctaagctccaggaagatagggagagtgataaatagcgcccagtggcggcaaggccaagcctggcagtcattgctagcctccaatctgaactaaagaatattccagacaacactggggcctgcagactccattcacaaatcccagggaccaagagccacccacataagcaaggggccccagcaccacggaacagggagaggagcacctgccaatgtcctgcggcctcctcctgctttccagctgtgaatgaggccctggttcccacacttcattcacagtctgggcggctactgtaactacatcc

SEQ ID NO: 324058 - DNA, 6692 bp, Homo sapiens
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324059 - DNA, 6569 bp, Homo sapiens
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324060 - DNA, 4099 bp, Homo sapiens
gggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324061 - DNA, 5293 bp, Homo sapiens
cagactgctgtgctagcaatcagcgggactccgtgggcgtaggaccctccgagccaggcagaaaatgtgctagattggaggtgaagaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324062 - DNA, 3742 bp, Homo sapiens
  misc_feature (13)..(13): n is a, c, g, or t
tggggtgatctanaggatccctatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324063 - DNA, 2024 bp, Homo sapiens
ccacgcgtccgcggacgcgtgggattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324064 - DNA, 5301 bp, Homo sapiens
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttggtagactcttgtggggactttatggcaagcacgttcaaatggtcgcaactcttatgcggccttgtctccatgat

SEQ ID NO: 324065 - DNA, 3042 bp, Homo sapiens
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactc

SEQ ID NO: 324066 - DNA, 515 bp, Homo sapiens
acaattcatgatctctttcctcagcctgttgaattggcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttctcctcttttactttcatatccaactttttttgaagttttatcactacttaattttttaaaaaaattcaacaccaccaattccagttttct

SEQ ID NO: 324067 - DNA, 436 bp, Homo sapiens
tcctattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattc

SEQ ID NO: 324068 - DNA, 361 bp, Homo sapiens
atacccctctggaagctctttccaccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttaggctgtga

SEQ ID NO: 324069 - DNA, 397 bp, Homo sapiens
caccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttaggctgtgagtcatcagctaaagcaccatctctctcttggctttatccctcgggcagggagggggtg

SEQ ID NO: 324070 - DNA, 6638 bp, Homo sapiens
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324071 - DNA, 6733 bp, Homo sapiens
  misc_feature (4146)..(4146): n is a, c, g, or t
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttgtaagtagtctttctgnacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324072 - DNA, 4203 bp, Homo sapiens
gttaaatacagattttttcaaaaattatatattttcaattgattggggtggtaaattataaagttgctatggatgttgccaagctgtattctgtttacagtggataattgtgtctttctctaggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324073 - DNA, 4231 bp, Homo sapiens
gaattccgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaag

SEQ ID NO: 324074 - DNA, 1700 bp, Homo sapiens
tataaaacaacttagcaggatatgagttatgacatttaggggtgttgtcctattgcttcagaacagtggggttatcgtgtaacacaccatgtcacatgatttgactaaatacaggaaaaaaaaaccctgaacttggtttcattggctcaaatatagttcaagacaacagagacaaagctaagatgaggaagttctgtacagtttaggaaatagaggctttcaaagataattcgcagtgatgtgaaactggcctcccaagccctgataacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaaaaaa

SEQ ID NO: 324075 - DNA, 421 bp, Homo sapiens
tataaaacaacttagcaggatatgagttatgacatttaggggtgttgtcctattgcttcagaacagtggggttatcgtgtaacacaccatgtcacatgatttgactaaatacaggaaaaaaaaaccctgaacttggtttcattggctcaaatatagttcaagacaacagagacaaagctaagatgaggaagttctgtacagtttaggaaatagaggctttcaaagataattcttagtaatgcttttggcattttattacattaattttttaaaacattatttctgctgcctagggtctttggtggggaaatgtactatttagcaatatgtttagtgaacttttgtcctgtcatggtaagaagaaagcagctataactaagtaaggagttactcttattcattaacatgtaaaacgctgttt

SEQ ID NO: 324076 - DNA, 1903 bp, Homo sapiens
tataaaacaacttagcaggatatgagttatgacatttaggggtgttgtcctattgcttcagaacagtggggttatcgtgtaacacaccatgtcacatgatttgactaaatacaggaaaaaaaaaccctgaacttggtttcattggctcaaatatagttcaagacaacagagacaaagctaagatgaggaagttctgtacagtttaggaaatagaggctttcaaagataattcgcagtgatgtgaaactggcctcccaagccctgataagtaagttaaataagagtaggagccaggagggaggttctttactcttgaattaagagaaggggagctggaggtggctcaggtagagtgcgtaggtttgcagaactgggcctgtgtgtgtaaagtgactaaggcaaaggagtggaagtttgagagaagtttaagagaagaaatggacatgattgcctaaatcagccaaacacaggcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaaaaaa

SEQ ID NO: 324077 - DNA, 1605 bp, Homo sapiens
cgcgcggccggcccctggccttcctccccttcctgctccgggcccgccagtagccggccgcggcggcgagggactaggacgcggctggagcggcgccgggagacgaggggctgagagacggcggcggccgaaagcggagagatgctgggcgtggcggccgggatgacccacagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaaaaaa

SEQ ID NO: 324078 - DNA, 1483 bp, Homo sapiens
gcttggacagccagctgatgagggacacatcgaatcaagatacatgacatgcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaaaaaa

SEQ ID NO: 324079 - DNA, 1798 bp, Homo sapiens
tataaaacaacttagcaggatatgagttatgacatttaggggtgttgtcctattgcttcagaacagtggggttatcgtgtaacacaccatgtcacatgatttgactaaatacaggaaaaaaaaaccctgaacttggtttcattggctcaaatatagttcaagacaacagagacaaagctaagatgaggaagttctgtacagtttaggaaatagaggctttcaaagataattcgcagtgatgtgaaactggcctcccaagccctgataacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagtaagtgtacggttttgtccagtgtgaatcctaagactgaaaactttggggggacactgaaaaaaaatcctagaatttagaaaaagagaattatttgatttcttatttcctctttctgttcaggccttctgaaagtaaaggttcttcctttaactgttccctgttctttcttctattccttctttgtcctactcaaagggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgtaaacttttctatccctgtgtcatcattttcactactttctcctttggttagtcctttggaatatgtttttgttctgtttctgtcttttgctttcttccccccctgcaacttttgggcgtgtatttgtagtcatcagaaattgaaaatacaagtatttgtcctatgtagaactggtccttttgcataactggctaaaaattacaaaaaattaaatgaatacactccatacttaatacagttttgtggccatgtatttcacttactctgtagactcactcaactcattttttaaacaccatatagttatacatttctttac

SEQ ID NO: 324080 - DNA, 941 bp, Homo sapiens
  misc_feature (937)..(940): n is a, c, g, or t
cctcgggcaagggacgctgctttcccctggcagccacactgctgagcataaatgctttaaagtgtcagcaattgatgtgtggagagaagtatgactgcattacagcttaaagagctttcacattcaggtctctacaggagaagacgagatcgccccgatagtttgagagtaaatgggttaccagaggaagagctacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggccctgtcagctgtgaggccactggtgctgagtcagagggaaaagctcagaacagccttgagcagtgaagaataaagtgtgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactctaaaaaannnna

SEQ ID NO: 324081 - DNA, 1014 bp, Homo sapiens
  misc_feature (1010)..(1013): n is a, c, g, or t
tataaaacaacttagcaggatatgagttatgacatttaggggtgttgtcctattgcttcagaacagtggggttatcgtgtaacacaccatgtcacatgatttgactaaatacaggaaaaaaaaaccctgaacttggtttcattggctcaaatatagttcaagacaacagagacaaagctaagatgaggaagttctgtacagtttaggaaatagaggctttcaaagataattcgcagtgatgtgaaactggcctcccaagccctgataacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggccctgtcagctgtgaggccactggtgctgagtcagagggaaaagctcagaacagccttgagcagtgaagaataaagtgtgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactctaaaaaannnna

SEQ ID NO: 324082 - DNA, 449 bp, Homo sapiens
tacagtttaggaaatagaggctttcaaagataattcgcagtgatgtgaaactggcctcccaagccctgataagtaagttaaataagagtaggagccaggagggaggttctttactcttgaattaagagaaggggagctggaggtggctcaggtagagtgcgtaggtttgcagaactgggcctgtgtgtgtaaagtgactaaggcaaaggagtggaagtttgagagaagtttaagagaagaaatggacatgattgcctaaatcagccaaacacagggtattgttgtatttctggatttgttttccttatgacctacctttctcagttatttaagaagcaaatctaaaggatatttgttgaaactctctatgcagaaagggtcttgggtgagttgtagtaaccttcagccatgctgattaaaattttctccctgctgcagaggttatgatt

SEQ ID NO: 324083 - DNA, 1191 bp, Homo sapiens
  misc_feature (1187)..(1190): n is a, c, g, or t
acaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggccctgtcagctgtgaggccactggtgctgagtcagagggaaaagctcagaacagccttgagcagtgaagaataaagtgtgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactctaaaaaannnna

SEQ ID NO: 324084 - DNA, 885 bp, Homo sapiens
atctcctttgcagttcagtctgttgcggtatgtttttatatgaagaaaatctgatcttacacagatgtgtagttggaaaatttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctattggtgatgttgtccctgcatcgtgtttgaggtgaggggccgactaaaggcaggggggaaaggtgcggtcaccgcactaattaacagaatacttggggtgataagcacgtaagctgagctcgggggcaaaaaacgacggaggcaaacttttcagaaacaacggcgtcatccgcaagctttttttcacttttctccttcgtctatatcttttcgccgagca

SEQ ID NO: 324085 - DNA, 1877 bp, Homo sapiens
acaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaaaaaa

SEQ ID NO: 324086 - DNA, 1627 bp, Homo sapiens
cctcgggcaagggacgctgctttcccctggcagccacactgctgagcataaatgctttaaagtgtcagcaattgatgtgtggagagaagtatgactgcattacagcttaaagagctttcacattcaggtctctacaggagaagacgagatcgccccgatagtttgagagtaaatgggttaccagaggaagagctacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaaaaaa

SEQ ID NO: 324087 - DNA, 795 bp, Homo sapiens
  misc_feature (791)..(794): n is a, c, g, or t
aaggcaaagggaaagttgtcttccagaggtgtggaggggagtgaagcaacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggccctgtcagctgtgaggccactggtgctgagtcagagggaaaagctcagaacagccttgagcagtgaagaataaagtgtgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactctaaaaaannnna

SEQ ID NO: 324088 - DNA, 1622 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324089 - DNA, 633 bp, Homo sapiens
aatgacatatcaccacctgtcactgtagtggcttaaagaagtgaggtctgtacttctgcctcttgaatatgagtgactctgtgactgctttgaccagtagaatgtggtggaagttttgctgtgctatgttctggaaccaagttttaagaaactttcatttttcactttctgaatcttagaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctgga

SEQ ID NO: 324090 - DNA, 1778 bp, Homo sapiens
tagagtatctaacaagaggaacaaggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaagacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324091 - DNA, 2046 bp, Homo sapiens
cagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgctcgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324092 - DNA, 1698 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaaagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324093 - DNA, 1610 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaaaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324094 - DNA, 1916 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaacttaaaaaaaaaaaaaaaaaaaaataaaaaaaaaaaaaaaaaaaaaaaatctggggggggggccctgtcccctataccctctattggggggggggttagaatccaatggccgcctttataccgcggggtgacaggaaacaccctgtgtcatcccattgtattcgggttgaaacatatgcctttctccccgtctggggttatagcaaaaagccccttggcacgcgctgttccaatggatgcacactcggcgtggggagtgttaaaatgagggccaaaactgggtggcaaaaggccgtgtaaactggttgaaaaatcctggaaatttgtcaaccctttttgcgcaaaataggaatgttctttaaaccccaagggtatcccccaaaaaagggttgtttttggaacaaatttgaaaaaataggactttttttgagaccgggttcgaaaccgggagaggggtgagtg

SEQ ID NO: 324095 - DNA, 1877 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccactaaaaataaaaaaaaattggctggatgtggtggggcatgcctgtggtcctagttacatgggaggctgaggcaggaggatcccttgagcccgggaggtcaaggctgcagtgagccatgatcccaccactgtactccagcctgggcaacagagccagactctgtctccaaaaaaaaaacactaaaacccaaaaccatattacatatgtcctgtaaatatacaccactattatgtattcataatacttaaaaataaaaaattaaaaacac

SEQ ID NO: 324096 - DNA, 1563 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccaggtgtggtggctcacgcctgtaattgcaacaccttgggagggtgaggaggagaaccact

SEQ ID NO: 324097 - DNA, 1577 bp, Homo sapiens
cagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgctcgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggtaagcatctcaggctttccccctaagaccaccctaggggtaagggccaaagtgaaatagaccagccctaaacaagcctaggtccagtccttgacaggaatgaaaacctgactctctgtggaagaagaaaacatcgtttaggcccttgacagatttttatctagaatgtctggcgtctgatcaaaatttacaagatagctaggcatggtggcatgcgtctgtagtcccaactacttggaaggatttcttgagcctgagagttctgggctgtagtgtgctatatcaaccgggtgtctgcactaagtttggcatcaatatggtgatctcccaggagcaggggaccaccaggttgtctaaggaggggttgaagcagcccaggtcagaaatggagcaggtcaaaactcctgtgatgatcagtagcaggattatgcctatgaatagccactgcacaccagcctggacaacatagcaagaccccatctttaaaaaaaaaaaaaacaaaaataaacggtaacgaaataataatactctctaattgcgattatccttgt

SEQ ID NO: 324098 - DNA, 1139 bp, Homo sapiens
cagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgctcgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggtaagcatctcaggctttccccctaagaccaccctaggggtaaggccagaaggtgatcactaggccagacgctaacacgtgttcgacagtgaaagtcgccaggttcatccagc

SEQ ID NO: 324099 - DNA, 1757 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324100 - DNA, 1511 bp, Homo sapiens
tagagtatctaacaagaggaacaaggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcgcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324101 - DNA, 1970 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324102 - DNA, 1456 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaact

SEQ ID NO: 324103 - DNA, 1640 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttctagggcaggcgcgccctgctcagagagtccttgtgtacgttgaaaataaagaaaaataggtgggaaaaa

SEQ ID NO: 324104 - DNA, 641 bp, Homo sapiens
ctcttggaggggcgcatcgggtggctctttgtgcggccctttgtgtggctcgttgtgcggctcgtcgcgtggcacgtggtatggccctttgcggggctcttcgtgtggctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggaaaaaaaaaata

SEQ ID NO: 324105 - DNA, 1366 bp, Homo sapiens
cagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgctcgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagcgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaatggtcgccaatccggggtaccgagctcg

SEQ ID NO: 324106 - DNA, 5497 bp, Homo sapiens
ctccagctcccgctagaccttgggacccgcctctgcttttccgcgttctccaactcgggaatccccggtgactttgtcgcagcctccgttaccctgtgatctgcaagtcctgggagacgcacagctaagatgcccggacatcctggaagctgggaaatggtgatgtgactcttcttcagcctgcaccctccaaaagaggattgtgatgtatcactggacccagcacctagatgacgtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcttttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcataccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctgtgatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatg

SEQ ID NO: 324107 - DNA, 5094 bp, Homo sapiens
ggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcttttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcataccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctgtgatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatg

SEQ ID NO: 324108 - DNA, 5239 bp, Homo sapiens
ctccagctcccgctagaccttgggacccgcctctgcttttccgcgttctccaactcgggaatccccggtgactttgtcgcagcctccgttaccctgtgatctgcaagtcctgggagacgcacagctaagatgcccggacatcctggaagctgggaaatgggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcttttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcataccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctgtgatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatg

SEQ ID NO: 324109 - DNA, 4172 bp, Homo sapiens
ggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcttttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaattgtgaagaatgtggcaaaacttttaattaatgctcataccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctgtgatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatg

SEQ ID NO: 324110 - DNA, 1684 bp, Homo sapiens
agcggccgctactactactagcctactactactaaattcgcggccgcgtcgaccacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctgtgatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatg

SEQ ID NO: 324111 - DNA, 5221 bp, Homo sapiens
ggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatgggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcttttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcataccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctgtgatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatg

SEQ ID NO: 324112 - DNA, 2379 bp, Homo sapiens
ggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcttttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaattgtgaagaatgtggcaaaacttttaattaatgctcataccttattgcacaggaaagaatttttacttggaaaaaggtatatacacaaagaatgtggaaaagccattaatatgtgctcatatcttactcaacatcagagagtctgtacttaataaaaccattataggaatctaaaaaaaaaaaaaaaacaaacaaaaaaaaaacacatttgtgtggcggcgcgcgcctcggggccccccgagaaaaggcgtttttcttacaaaccaaattccgtttgggggcgcgcccggggccccccagggttaccgtggcacccgtgtggcgcccacccgcgcgtgtttccccccagaggagaaaccccccggggcagacagcacaaaggcgcgcctggaggatctccctcccccgaagattaataaaaaacacgcgcccgggttggggaaccacgcaggcccttttgtttaaaagcaaaactccaagagaaatggaaggtcttcgaagcaggtccaacaacccgggcgaatctactaatccaccaaaagggagagttccccaccagggcaggagctctccataaatataaaaaaaattaaaccgcccccggcttcggagagggtagctcccacgacatggacaggcaatgactcgacaagcacaaaaactctcacacagcaacacaccacaaatgatcgcagaactcaccacacagctgacgacaaacacctataacaggccacaccacactcaaaac

SEQ ID NO: 324113 - DNA, 780 bp, Homo sapiens
caaaatccaaaaaatattgaaatccacaacactttgtgtcccaggcatttcacacaagggatgctcaatctatattttgaaactcatactttgctgtcattagagaaaaaacacaagtttgtttttttttgtaatagtgtcttgctatgttgcccaggctagactcaaactcctgagctaaagtgatcctcctgccttagcctcctgagtacctgggattacaggcacgtgccagcatgcccacctagacacaagttgttattgtacattttcaatagtcaagaaaaagtaagtaaattagaaggaaaaaaaaactacacaagggtttaaaaggcagacccttttaaaaagttttttatttattttcctcttttcatgataataatgttaaacctgacagctaaattgccaatacatactatgaataagatcttggtcttggaataaggtcatattcttcctttctaaggggaaacccgtaggatttttgtgcatccaatttgcagttcagttcagttaattatgccattgtagaccttccgtttgaggcttgcaaaattgtatattatccataaagcagccaccatgattttttaaaattatcattgaagccattcaccggagatgtcagcgtctgttggactccgctcacatcgagacaagaccgccacctgtcagaacagccactgcttctccacatttgatcctggctcggagcaatgcctgtctatatctttaaaagagaaaaaaaataaaatgacttgaattgttccaaagatg

SEQ ID NO: 324114 - DNA, 8035 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324115 - DNA, 708 bp, Homo sapiens
cagatataataaccatgttgactatgggggagagacgctaaccttccaagtaacactttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324116 - DNA, 1898 bp, Homo sapiens
  misc_feature (121)..(121): n is a, c, g, or t
  misc_feature (178)..(178): n is a, c, g, or t
  misc_feature (479)..(479): n is a, c, g, or t
gagacagagttttgctcttgttgcccaggctagagtgcaatggcatgatctcggctcattgcaacatctgcctcctgggttcaagcgattctcctgccttagcctcctgagtagctgagantacaggcgcccgccacaacgcctggctaattttttgtacttttagtagagatggggnttcaccgtgttggccaggctggtctcgaacttctgacctcaggtgatccacccgcctcggcctcccaaagtgctgggattacaggcgttagccacggcgcccggccaagaattttcatatgataggatgaggcatgactctttcaagtattaacaacgctgcagaggtgagttggcagcacagttgctcccagtgagacattggctctttaggggttttttgtatttaaattgaactgcacaaaatgaagcgggcccttgccaagaagtcactggtgcttgctccattcaccagtgggggnccattcactgctttggtctacagaaccttggcacagcctagttcctcccagcagccagcccccatcagtctaaaaattaacagttagtgtttgcctcctaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtgaggagaggcagctgctgcttgttctgttagatgcctttgctgcagatacacctgcgtcaggaacattgtgcagcattagagtggctgtcctgcacagttgcagtttgcttagtacagctctcaatactaaggaaatgcatgtaacccagaagcaaccacacgaatatagagataaaaatatatatattgagtggaaacacagagataaagtacctgagacataatcttgctaatctgagaagcagctgagtgtctagcagagctgcagacctggctcaggtccagccactttgatgagggtttattgcagtgcttctgcaacaaagtgtttgtttgcacgtgactagctagatgaatatcagatgaacacattttctttttaaaatttgaacttactattataaaaccagttggccaaaagggtggtaatccaataaccaccaccccgacccccaccccccaaggcttcttatggaaaaaaaaaaaacgtcatctggagtctctgttgttccttggagttcataaatttatcagccaaaagacaggactgaagcttttcacccgcttttcctgttaatataggtttgcaagaaatcagcccagcatctgcctctaccgatgggcaaaataccctgagttattttcagcaagaaagagataaacctaatctcaagagaacaaagggaaaatagtacttttgaaattctgggatgaccacacgggtaacatttttaggaggctggagacgcccttgtgccagcagctccctctgggatcaggtgatggcacgttctgggaacacgtgttggggccgcagcctgtggaactgaagtccccctggtgtgtcttccaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagtaggttccttttccctactgtgtcagaagagcaaataagagaaattgcagagcagggttcagggtttgagcttcccattccatttgtggcttcacgctgtattggagttagtttta

SEQ ID NO: 324117 - DNA, 550 bp, Homo sapiens
agctataagcaggatacaactatgaccaggagacgataagagacaggagaacatgcatatacgagagaaagcgtgaccttctccaactcctacggcagccagtggtcccccgactaccgctgctctgtggggacctacaacagctcgggtgcctaccggttcagctctgagggggcgcagtcctcggtaagtacctgcctggcgtgtcccagtgaaatgggtggccggtcacacccacccctgttgcatcctcaagttgaatgaagatacccgtaggatatctgtgcaaagattgcagagtcgtggtcttagagatcatcttaaaccttttgcttattccataagccaattgcattcataagtagaactttgatgtgcctgtttcagttttagcacaaagcctagagctgagctgtgcccaagacttcagaaaactggctatttatttatttattgtaggttgtacggcgtgtgcagtttggtgtctcggcgtgtgcagtgtggtcgctcggcgtgtgcacgtgtgcagtgtggatactcggcgtgtgca

SEQ ID NO: 324118 - DNA, 8018 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagaatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324119 - DNA, 5798 bp, Homo sapiens
cagcacagcccgagacgcaccacataaaaggctgggaacaccagccagccgaagaaagcccatttttgtgtctgtcagcttagatgcccttgcccggactgctaaagatgcagctatttacagtggacagaaactgaaggggtgaaagaaaacccaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324120 - DNA, 7980 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaacatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324121 - DNA, 2295 bp, Homo sapiens
gaaattctacttcaaactttactgcttcctggacacatccatggcaggtccccaacctcggatgtggcatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324122 - DNA, 4837 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggagg

SEQ ID NO: 324123 - DNA, 4275 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggtgctgtttgagatacccgagtacgactttacacaggccacggccgagggacatggttaccgattctcgagcggtcgttttaggacgtcgtgtagggatagcggatacaatgttaca

SEQ ID NO: 324124 - DNA, 3294 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagctgatggggagcaagatgcgcagtcttctcccatcagctgtggaataatggcaacagaaagactggctaactacaccggaggcatctatgccgaataccaggacaccacatatataaaccatgtgtttccgtggctgggtgggcatcactgatgacgcagcttcggtccgcta

SEQ ID NO: 324125 - DNA, 2109 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgttgggcgatcagacattttaggcttcttcttctgcttctcagtattccgggtcaaagcatctggtggagtggtgttattttcagtaggtgaaatgggagatgtagccacgtcccgagttggagtgacaggaagtggttcaatcacagaccgtgtgatacagattttgtgtgctctgggcgtggagcaatcactggtgttgtgt

SEQ ID NO: 324126 - DNA, 383 bp, Homo sapiens
ttgaacgagctattcttgaaagcaggtatttattgattttcttgtttccaactaataggattcactttccttatggtatggcttatttaaagaagagttaaaattagttggtcgcgtttctctttttcttgacttctcttttacaattccttaagaaaaggtcttgccatgcacatagtaatatctcatgaacccagcaacaactccttctgcctcctgccccttcatcgtcaggccaggtctgagatggggactgagtggcgcccaatggctgtctgcagagcctttgactccagcttcatgtgtttttgaagcacctgcatcagataaggcacttgtattggagtttatggagaagaataaacttgactagttttctggag

SEQ ID NO: 324127 - DNA, 340 bp, Homo sapiens
tccagcctgggcgacagagcgagactccgtctcaaaaaaaaggagttgcaaatctctgacaggatcttggggacacccataggattcccagaccacacttcgtccaagcacgaggctctatgctactaatctaggattcactaagggaatgagtaacttagcaataacatgcaatctctaaactctgtgtgagggattcaggtgtgttctctgcgttaaggtatcgctaagcctggttagcttcttgggggcggtgggttcattcacctttgtcttattctctgcagctttgggcagatctgcggagttacttgggctggacccaacacagctcacagat

SEQ ID NO: 324128 - DNA, 10091 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggaggtgagaactggctgccatgtgttggggtgggctgggtgctggcatctgagaacatggatcacggccaagttcatgtggagagaagacaagatggagcattttgctctctcaacctctttttttcgagcccccaaaattgtaccattaacgcctcccttctcctcacagtttctcttctcctgtgtagtaaatgcatctgtaatattaggaatgaatgcaaaattaagatgtcatctattcttctacccttccttagggaagctatagatctaattttttaaacactgataaaaatctacatttaaaaaaatgttatagctgtatatacaaattagaaactttggatatacttgcattttactttgttttttctttacagccatctgtttgaaaggaagaatgtctatctcgtaatggaatttagccattggcatcaacccagtactgatttttgttttgttttaagtagaccgcttattgaaaagaaatcttactaattgtctagatgagagtttggcaaactggtctgtgggtcagatcttgcctgcctccttttttctaaacaaagttttattggaacacagccaagctcattcctttagatatattccctggctgtttttgtacagagttgagtagttgtgacagagaccatgtgatccacaaagtctaaaaatctttactatgcagcccttaacagataagtgtgccagctcatcgtctagattagcttccattttttatgatcacagtaattcagcgtatatctgatgactttatattgaggctgtataaaattctaaatattataaattctagaatccgtgggtggcttttcattaggtgatgtttttgattggtttggttggttcaattatgcctgtttttaagtataaaaaaatcaggtgctttgtacaaagccataattccatttctccctgacaaggaatagataatagcagttaaactcttggcttcctgcaaaacgtgagctgtgaattagcatagaaagctactggcttggccgggcgcggtggctcatgcctgtaatcccagcgctttgggaggccaaggcgggcggatcatgaggtcaggagatcgagaccatcctggctaacacggtgaaaccccatctctgcaaaaaattagctgggcgtggtggcatgcacctgtaatcccagctactcgagaggctgagacaggagaatcgcttgaactcaggaggtggaggttgcagtgagccaggatcacgccactgcactccagcctgggcgacagagtgagactccgtcaaaaaaaaaagaaaaaagaaagctactggcttttgcatggaggatgcagagaatgtctggttattagggatataaactagagactcttttcagcgtctccaatttatagccctcctgcttgtccaggtttggatcagccctgtgttgttagccccttcatatggggtcttattttcttccaccaatctgtacaggaaagtctacagttaaactggtaaagtccctgttcccactctgcatatggaaggccattgctgctccttgtgaagaggagccagaactgctcagcatgcgtgatttggagaattttcctctgtgatcctagattttgtatttgaagactaaccatccgcaaagaggattggaggcagaactggagatattaatacaagagtagacttggcttgggttgcagggaagcttccttaagtcccccggccaagcatgtacgtttccaggccacttccacgtagctaatccaaacagctagtagaataatgctgagaagtggagagtcaaagcaagatgttagactctgccagttagtgaggttttcccaaaagcgtgagattaactagttagaaatcaagatagccagagaggtgccatttttcatatttcaggcccctccatgcatgtatgcacatcgaatatatttaatcttctgcacagaggacttcactcaaagcctgtcttatggtttagatgctttctgttgccaaccacttcatgacttaactcttctgttgactcttgcccaccagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324129 - DNA, 7965 bp, Homo sapiens
  misc_feature (1237)..(1237): n is a, c, g, or t
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattcttttcacatgaagatttattagaaaaaaaccgagtagtaagcnacgagatatatgaatattatctacgccagaactaaatatatttagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324130 - DNA, 3619 bp, Homo sapiens
agaagccaggaagaaggcactgagtctcggttcacacagaggtgatgctgacggtagggctaaggggctttgtttccttctcatcttgtggctcagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324131 - DNA, 6327 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacggctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaaca

SEQ ID NO: 324132 - DNA, 4970 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgataggtaagctcagatgtggctcttaacaaaaacagctcatcacctgtgtgtgtccacaggtgtctgtgctgctgggtcacgaccctcttcacagggctgtgaaatcacgcaaggctgtgtgttcccaccttgtcaaccccagcaatccagtcttccttcttggtacccaattttacatcacctggaagtctccttctctgggtatctttggagtcctggggaaaaccgtgggaacctggacaattttaaaaagcatgaggaatatttttaatgtgtatacagggacaaacttgggatttatacaggaagaaaatgcctgtttaggaaaatgatattccagcaaaggggaagggagtcattctcctttctgaacttaacgataaacttgaaaaggattttgatgataatgtatatgtagagtattaataaaccacaaacattgattttccttgacatttctt

SEQ ID NO: 324133 - DNA, 3414 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggagg

SEQ ID NO: 324134 - DNA, 914 bp, Homo sapiens
gagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatccattcaccggagatgtcagcgtctgttggactccgctcacatcgagacaagaccgccacctgtcagaacagccactgcttctccacatttgatcctggctcggagcaatgcctgtctatatctttaaaagagaaaaaaaataaaatgacttgaattgttccaaagatg

SEQ ID NO: 324135 - DNA, 496 bp, Homo sapiens
atttttaaatgtttcatttcagaatggcatcttgagtctgaaacacaatgacttttctctaagtttaccctgctcaaatagaaatatttgtgtaacatgtaagtgtctgtctggatggcagaaactagcaactgattttctgatattcctaagccagtctcagtgagattttttatcacctttgaatttgtatatgaatccaccaatagtggcgacagttgttatatttttagctgataaatcatagttgaggttcttaagatattcatttggataatcaggatagcttactaggagatattaaattgcgcattccatgtggactataatacccacacacaccaggcaagtattcccatctatgtgagggcagagatgtttcattatgccacctgcccaccagggactgccaacaaggaactgaaggacatttttttttcttagagacagggtcttgctctgtcgcccaggccagagtgcagtgacactgcagcct

SEQ ID NO: 324136 - DNA, 291 bp, Homo sapiens
tgtgcaacatttggtatggtatctggtgtgatctttcagggtaaaagtaggtaaattaattgctgtccttatttggcccttactacacacaacacacaaatctcttccaccattgcaaaatgttagaagatgtatgtgctgtggccggacgcggtggctgacacctgtaatcccagcactctgagaagctgaggcaggcggatcacttgagtttaggagtttgaaactagcctggccaacatggtgaagtcccgtctctactaaaaacacaaaattagctgggcgtgatgg

SEQ ID NO: 324137 - DNA, 161 bp, Homo sapiens
gtcatttgtatatcttctttggagagatttcaagtctattgtccatttttaattagattttttatttttgttgtaaaaattctggatattaatcctttgtcagatatataacttgcaaataccattccgtgggttgaattttatctgttgatattttcttt

SEQ ID NO: 324138 - DNA, 296 bp, Homo sapiens
ccaaataaaatttactaagcacctacctccatactaatcaccctgatgagtcaaaggaatagcctgggcccttgacctcgagaggcttctgagggtccattatttctgtcattgactgcatgtgatacaatactgaccaacaagataccaggaggctcccggggaaggttttcttcctaaagagacccccaaggaataggagcccttttctgcccttggatgcaacgtttatagacggtaatatctgcaacagttgtggccacccttggaccaacaggagacaagcttgaagagaa

SEQ ID NO: 324139 - DNA, 214 bp, Homo sapiens
ctagagtatcccctcggaacgtgttatcctccagtaaatcagaaacaaaacagctttttctggagggctctctgcacccctgcaatgtcctaatgtgcccccacacctgcgtcacaaacttgcctaagcctcgacagaagcagccaggtatgtgcaccacttgggcagcttgtgaggtgcgggagttcccttggggctgcacggcactgggagg

SEQ ID NO: 324140 - DNA, 7132 bp, Homo sapiens
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaagtggcacatttaaaaaaattgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagctctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcac

SEQ ID NO: 324141 - DNA, 7131 bp, Homo sapiens
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaagtggcacatttaaaaaaattgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcac

SEQ ID NO: 324142 - DNA, 6025 bp, Homo sapiens
gtcaagttgcaccacgttgctgatgtctggtgtggcaggtggtcctgatgttagttctgaggttcctccccatatctaaatggcagatgatgtcacgcccctaaatacaacttgcgcattaacattaaagcaattgaaatatttattgatgtttcaactatgaaatttgacatgttgctgcaacaggaaaactcatggctctttagggaaaatgagtgcctggctgactaccatccgtgcagttttgctccagaccccattcctgttcactggtgtcgttcatattcgcgtcttccctgtttcctttattctccccacctgccccctctcacactgcatgtgctttcctgtttgcttttagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaagtggcacatttaaaaaaattgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcac

SEQ ID NO: 324143 - DNA, 272 bp, Homo sapiens
ttgctttctaaacagtcttgaaaggaaatggcataaagatgagattgaggttggcttgtgtgtagtctctccctgtattcctcccattgacaagagacttttcctctcccaaatagatacttccaggggttcggattataattgccaacccagaaacaaaaggaccgctgggggactcacaccttggagaggtgagttgagtgtcctccgagatccaggttacttttctgttatgtatccttggcttgccttgacaccatcagaactgctca

SEQ ID NO: 324144 - DNA, 209 bp, Homo sapiens
ttggttgcacaggtctgtgcttgttctaaaaaccagtgatgtatgctttgcgccagtgagttgtatgacgcgtgcgcgctctctgcaagctgctctgctgaaggaatcttatgtgcttgtccctgtgatcggcccgcagggtgcgatagcgaactcgctgacctgcgtgcagctgcacaagagagctgagaagatcgccgtgatgctga

SEQ ID NO: 324145 - DNA, 7185 bp, Homo sapiens
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaagtggcacatttaaaaaaattgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcac

SEQ ID NO: 324146 - DNA, 7124 bp, Homo sapiens
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaagtggcacatttaaaaaaattgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcac

SEQ ID NO: 324147 - DNA, 6160 bp, Homo sapiens
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaagtggcacatttaaaaaaattgtgtctgcatatgtggtgcatccttccatctccacaaaccatttgattcttgaaatattgtttgacctcattgctgtgtgtgaatatttctccacatgcttcagatgcacattcctagtctctgcttcctaaggggggatgagcataagaagggataaggagggatgagcataaggagggatgagcataaggagggatgagcatactggatgggatgagcataag

SEQ ID NO: 324148 - DNA, 225 bp, Homo sapiens
cacaccttcctgtgaattaaacagattgtattggtctgggttataatgataaactgttcagtttcaggctgggcatggtggctcatgcttgtaatcccagcactttgggaggtcgaggtgggcagatcgcttaagctcaggagtacaagagcagcttgggcaacatggtgaaaacccatctctactaaaatacaaaaaaaaattagccgggtgtggtggtgcctg

SEQ ID NO: 324149 - DNA, 1954 bp, Homo sapiens
  misc_feature (3)..(4): n is a, c, g, or t
ggnnttccttgaaaattttccttggataggaaaggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324150 - DNA, 2040 bp, Homo sapiens
gcccctcaccaacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324151 - DNA, 2524 bp, Homo sapiens
gcccctcaccaacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtgagatattgcatgaggatgctggctgaaagggctagaataggctgtgggacatgactggtaggcagtgagccttcactcatgactcttagtgatcattaagacctggacaggcagtgagtctggggctgctcttctattagcatgttctttttagaggaggggaccagggtcttcacctcagggcttggtgaggttcctacccatgtcctgacagaacctaccctgcatcttcacaggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccaggtcatggaaagaccctggtagtgggcaggatgcctgaattctgcctcctggtattgtttccagaaatggtagagagaggggcacacatgacagtagtcttatctctccctgaggttcctgtatccctgggagatattataccaccttccttagatgaaaatgaggtccaaagtgtgaacctacttttggaaagcaagctgggtatctgaaatcctagttctcattttgttgaccttatcttgcagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324152 - DNA, 761 bp, Homo sapiens
  misc_feature (136)..(136): n is a, c, g, or t
  misc_feature (138)..(138): n is a, c, g, or t
gtgtgtgagttttttttctctctgttcttaatattatccccccctattttttttttaaaaaaaaaaaaaaaaaaaaaaaaaataaaaaaaaaaaaaaaaaaaaaaaaaaaaaaaaaaaaaaaaaaaaaaaaaaaananaaaaaaaaaaaaaaaaaaaaaacgacccccacaagggggaaggccccaagtgggcccctgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324153 - DNA, 613 bp, Homo sapiens
acccccacaagggggaaggccccaagtgggcccctgcctgttgttctctgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324154 - DNA, 579 bp, Homo sapiens
acccccacaagggggaaggccccaagtgggcccctgcctgttgttctctctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324155 - DNA, 374 bp, Homo sapiens
ttctgctagccactgacccagtttgacaccctctactttgttctccatggagaaggcttcatcttttccccctcaccagtggatgtctgaatacattcaggggcttggaagtgccagctttactacccattccctttactgcctccttcccatgtcaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtg

SEQ ID NO: 324156 - DNA, 2285 bp, Homo sapiens
gcccctcaccaacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccaggtcatggaaagaccctggtagtgggcaggatgcctgaattctgcctcctggtattgtttccagaaatggtagagagaggggcacacatgacagtagtcttatctctccctgaggttcctgtatccctgggagatattataccaccttccttagatgaaaatgaggtccaaagtgtgaacctacttttggaaagcaagctgggtatctgaaatcctagttctcattttgttgaccttatcttgcagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324157 - DNA, 2009 bp, Homo sapiens
gcccctcaccaacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtggggggtcgttttttttttttcttttctttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggg

SEQ ID NO: 324158 - DNA, 2686 bp, Homo sapiens
gcgagacgaaggtgcgcaggccgatgcccgagagcgggatgatgaccgtgaagacgagccagccggcgatgagggtgaaggccacccagcgccacttgcccagcggcaccgcttctggcgcgcgcccttgcccttgatggcgacgaacttgttggccgagcgcacgagccagcgctgcagcatcaccagcggcatggtcaccgccaccaggcacacggccaccgccgccatcaggtgatacgaaggcgtacccagcttgttggtgagcttgtagagataggtcggcagcaccaggtggccttccggatcacccagcaccagcaccaggccgaacacttcaaagccgaggaagaacaccagcacgccggagtaggccagcgccggggtgatcatcggcagcgacacgttcaacgccacctgcagcggcgaacgaccggccacgcgggccgcttcttccacatccgaacccaggctgcgcagggccgccgaggcatacaggtagacgtgcggcacgtgggtcaggccggcgatgatgacgatgctggtgaaggaatagatgttccacgggtcgccctcgaaaccgacgaccgacagcaggttcttgacccacaccgtgtagaagccgaccggccccatcgagaccacgtagccgaagccgatcaccagtgggcgagacgaagatgggcaccatcagtggcgggggcggatcgaacgctgcgacccggcaggtcggctgcgcaccatcaggaaggccaagcactcggccgagcggcacggcgatcagggccaggccggtcgccagcgtcaagccgattgacgaaggcctggcggaagtccgggtcatcgaagatgaagcgataggaatcgaaggtgagcgtcttgaccggcgcaaagaacggcgccgacaggaagctttgatagaagatcagcagcagcggcagcgaagatggccagggctgccagcagcacgaccaggccgcgcggccagttcagccggaatcggcgggcggcagggcttgctcgcgcgcggcacgttgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324159 - DNA, 1212 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgaactccgtagataaaggccggcctcccgttcgcaggacggccggacgttaggaccaaaacggcggccggacaggcgaaggacccgacgaccgggagccgaccgaaagaggggcccgggagagaaagcgagaggaaacctgggcccgcacaaaacgggaacacagggccttgacagccaaaataggcaccgc

SEQ ID NO: 324160 - DNA, 1103 bp, Homo sapiens
gatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324161 - DNA, 2489 bp, Homo sapiens
  misc_feature (1964)..(1964): n is a, c, g, or t
  misc_feature (2035)..(2035): n is a, c, g, or t
caagtacctattggatcaccagctgtgtgccgggcttctagttgagcaacacagaggcagcctctgccctctgagcctcctgcattcggtctcctcattgtcatttgctgtctcaggcaaggtcagtttggctgcaagtatcagaaataaacttgagcttcctgaaacataaagggccctgttgatgtagaatcatgggcatcctttggagttcggaggtatgtgatgtccgtggacctgagaacctggtagctgacgctgttaagagctggggcaaccaggccaggcgtggtggctcgcctgtaatcccagcactttgggaggccgaggcgggtggatcatgaggtcaggagttcgagaccagcctggccaagatgttgaaaccgcatctctactaaaaatacaaaaattaactgggcgtggtggcgggtgcctgtaatcccatctactcgggaggctgaggcagagaattgcttaaacctgggaggcagaggttgcagtgagccaagatagagtcactgcattccatccagcctgggtgccagagcaagactctgtctcaaaaaaaaaaacaaaaaacaaaaaaactggggcgacccacctgtgatgtgtgacagcccacagcttgcttctgcctcgtttgcctccatgcagctaggtcggtcccatgcctctttgcactggcccagtgcagcaggccacaggccccagctttacactcagtcctggatgagtctcttgtttcggggtgggcacatttgattgactcagtgttgggcctggggtcctgttgctcaggcatgcttattgaggactgaatcctgcaaagctgagtgacagttgtcagagaagatgatggtccctgggcagacacccaggcagtagtagccacttggggctcctgtcctgcctcccagccctgtgtcctggctctggactcgcctgtgctagggagaccacgctctcagctgctgagcctcggagcttaccaggcatgttcttaccttactctggtctctctggggtggagtgggttcttatagctctgctgtttcctgttggggcgggaaaatgctagaatctcagtctttccagaatctcagaatcttctagttcaattgccattcaaactttttgttggtgttagccaataacatcttgactcggtgcacccgcagaaatactgtaacctaaagtttgaggaaacagttttttctatgtagtaagtatatagttgtattctgctgttttgtttcttaagatgttggttgcaacccatcagattgatgatgggactcatttctgggtcatgacctgaatataggaaaggctagtctagctgccctgtgcctgtgacatggcaggtgcctggtccgctgcctgcttctataagaatgtctccctgcagcctcttttctatacagaactcagccctgcctcacggaagcttttccaggcagtgcgagatagaggagcgcttgagaaggcaggttttgcagcagacggcagtgacagcccagttctgcaccttctttgctgagtcactgtgggccagtgacttgatctgagattgtttccccatcagaaccatgaggttatcatctgtgccttggggctgttcatctatctattcacttgacacacacacatccacctttctataccagctgcagcgccacctgctggtaccgtgagcaagagctgggcatgcccacggttccggtgccctgcagtctggtgggagaggcaggtaggggtcgactcaggtagcaaacctgaaactccaggggaaggaagcgtttctgcaactgtgagtacataggactgtgaggagagacttcccgagaaaggatgttcgggctagcgttaagggtgagcgtgagttcaccagagaaggaaggggagaccagtccagggcaaggagaatgcacagacactggcaggaaggtgagcgtggggacacngggaaaggcctgggacacgcagccaagagccgcggctcagacgctagcagggcccgctcttgctgcctctnccaccagttgacgaggagtttggaccttaggctgggggacgccagcaaaggcttctaagcagatcacatttttgggtggaaagatcattggcttcgggtttctgtgagggcgaggatgattggaagggagggttttgaggaggctgtgaagtgcgctatggttaagatgatgcgctttggggccagacatgggttccagtaacggctgttgcctagcgaacgctttgtgtgagttaattagagaagacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324162 - DNA, 1826 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324163 - DNA, 1744 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgaccagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324164 - DNA, 1874 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgagatagtgggcaaatcggtttc

SEQ ID NO: 324165 - DNA, 1916 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324166 - DNA, 1889 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324167 - DNA, 3170 bp, Homo sapiens
gatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324168 - DNA, 1715 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324169 - DNA, 3143 bp, Homo sapiens
gatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324170 - DNA, 950 bp, Homo sapiens
tacagctggtcggtcccgagtccctttgatggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324171 - DNA, 1352 bp, Homo sapiens
  misc_feature (1305)..(1305): n is a, c, g, or t
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcggacccaagagagcgcttgngcgttgcaaaagcgacctccaagcggttagcgccctaaaaaggctta

SEQ ID NO: 324172 - DNA, 3752 bp, Homo sapiens
gatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgaaaaaaaaaacaaagaaaaaaaaaaaaaaaaagggggggcgcgcaccagagagagaaatctcccccgagaggggccccactgtcaagagcggatccccgcgcaaccgggagcaacaagggggcccaaggcggagaggagccacacacaaccggccagggccacgtggccgcgggcgcttaaaccaccgcccgcggcacgggggacaacaagcgggaacaccagggagaacacaagcggaaaagagaacccaaacacaacaggcggaggcgcacgaccctagacacggcgcggcccacgcacccgccccccaccccgcagacaccaacacacgcacacaacaagcgcgacccacctcctccacaaaggccacaacagccgcagtcccctacccgcgggcgggcccacccccaccacacccgcggcgccgactacgacacaaagagcccgaagcacgggagcgacaaccgaacatacacgggcgacacacccccgggggccgcactcgcgcaccgcccagagcgcacgacacccgcgaaataccaaccagacgagggcgcacacccgcacacagcgccgcaaccc

SEQ ID NO: 324173 - DNA, 1324 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324174 - DNA, 1365 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttccgcttacaaacacgcagatggcaagaagggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324175 - DNA, 989 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccaccccttggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324176 - DNA, 948 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324177 - DNA, 1041 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctcccaccccagtcgcccccgtagcctccccgca

SEQ ID NO: 324178 - DNA, 1040 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttggtataagggtttgtatcatgggtaagatcactcagcaccgcacacctttactcgtacacacagcaaaaaaacacctaaaatcagtttaaatgtttccgcattgatctgatgtaaagataactt

SEQ ID NO: 324179 - DNA, 364 bp, Homo sapiens
atcaacaggaaattaattttatttttaaatccaaggggccagaacaaatgagacacctacccttggaggacaaactcaagtgccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324180 - DNA, 823 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgagggtcatctcttaggtgcatcagagcacacctgagaaaagctggcacacagtcggaagttacaagaagaacgttctagcattgggtaggtaagggcagctggaggcgagggagttgcagagcagaatttcgtagataacagaaaggaccctcgagatgcccctcctccaactcgtgctgaaacccgagaggagcgcatggagaggaaaagacgggaaaagattgagcggcgacagcaagaagtggagacagagcttaaaatgtgggacccccacaatgatcccaattccacagggggcc

SEQ ID NO: 324181 - DNA, 292 bp, Homo sapiens
cttcctgaccccctgttttaccactgtctccagatgatccttgacactagggcacttctatctgcattcacttctccacctcccctttctcctgacagagacgggaaaagattgagcggcgacagcaagaagtggagacagagcttaaaatgtgtaagtctctcatccaccatttggctctctcctctcccaaaccctctgtattcttcccaggtcatacccaggaccctgctgtctccctaaggcctgtgttgtggggaacagggttgttagttcatttgtttagcccctg

SEQ ID NO: 324182 - DNA, 1853 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324183 - DNA, 3936 bp, Homo sapiens
  misc_feature (1964)..(1964): n is a, c, g, or t
  misc_feature (2035)..(2035): n is a, c, g, or t
caagtacctattggatcaccagctgtgtgccgggcttctagttgagcaacacagaggcagcctctgccctctgagcctcctgcattcggtctcctcattgtcatttgctgtctcaggcaaggtcagtttggctgcaagtatcagaaataaacttgagcttcctgaaacataaagggccctgttgatgtagaatcatgggcatcctttggagttcggaggtatgtgatgtccgtggacctgagaacctggtagctgacgctgttaagagctggggcaaccaggccaggcgtggtggctcgcctgtaatcccagcactttgggaggccgaggcgggtggatcatgaggtcaggagttcgagaccagcctggccaagatgttgaaaccgcatctctactaaaaatacaaaaattaactgggcgtggtggcgggtgcctgtaatcccatctactcgggaggctgaggcagagaattgcttaaacctgggaggcagaggttgcagtgagccaagatagagtcactgcattccatccagcctgggtgccagagcaagactctgtctcaaaaaaaaaaacaaaaaacaaaaaaactggggcgacccacctgtgatgtgtgacagcccacagcttgcttctgcctcgtttgcctccatgcagctaggtcggtcccatgcctctttgcactggcccagtgcagcaggccacaggccccagctttacactcagtcctggatgagtctcttgtttcggggtgggcacatttgattgactcagtgttgggcctggggtcctgttgctcaggcatgcttattgaggactgaatcctgcaaagctgagtgacagttgtcagagaagatgatggtccctgggcagacacccaggcagtagtagccacttggggctcctgtcctgcctcccagccctgtgtcctggctctggactcgcctgtgctagggagaccacgctctcagctgctgagcctcggagcttaccaggcatgttcttaccttactctggtctctctggggtggagtgggttcttatagctctgctgtttcctgttggggcgggaaaatgctagaatctcagtctttccagaatctcagaatcttctagttcaattgccattcaaactttttgttggtgttagccaataacatcttgactcggtgcacccgcagaaatactgtaacctaaagtttgaggaaacagttttttctatgtagtaagtatatagttgtattctgctgttttgtttcttaagatgttggttgcaacccatcagattgatgatgggactcatttctgggtcatgacctgaatataggaaaggctagtctagctgccctgtgcctgtgacatggcaggtgcctggtccgctgcctgcttctataagaatgtctccctgcagcctcttttctatacagaactcagccctgcctcacggaagcttttccaggcagtgcgagatagaggagcgcttgagaaggcaggttttgcagcagacggcagtgacagcccagttctgcaccttctttgctgagtcactgtgggccagtgacttgatctgagattgtttccccatcagaaccatgaggttatcatctgtgccttggggctgttcatctatctattcacttgacacacacacatccacctttctataccagctgcagcgccacctgctggtaccgtgagcaagagctgggcatgcccacggttccggtgccctgcagtctggtgggagaggcaggtaggggtcgactcaggtagcaaacctgaaactccaggggaaggaagcgtttctgcaactgtgagtacataggactgtgaggagagacttcccgagaaaggatgttcgggctagcgttaagggtgagcgtgagttcaccagagaaggaaggggagaccagtccagggcaaggagaatgcacagacactggcaggaaggtgagcgtggggacacngggaaaggcctgggacacgcagccaagagccgcggctcagacgctagcagggcccgctcttgctgcctctnccaccagttgacgaggagtttggaccttaggctgggggacgccagcaaaggcttctaagcagatcacatttttgggtggaaagatcattggcttcgggtttctgtgagggcgaggatgattggaagggagggttttgaggaggctgtgaagtgcgctatggttaagatgatgcgctttggggccagacatgggttccagtaacggctgttgcctagcgaacgctttgtgtgagttaattagagaagacgtggctgtcttgtgatgggagtgcgcgggatgaactgcacggggggacccggccctgtgaacactaagccaggggctgccttcctgccctttgctcttggagtcggctcatttctgctcctccgggccctgtccctgcccagattcaccctctgtccgtctgccctgccccaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgaaaaaaaaaacaaagaaaaaaaaaaaaaaaaagggggggcgcgcaccagagagagaaatctcccccgagaggggccccactgtcaagagcggatccccgcgcaaccgggagcaacaagggggcccaaggcggagaggagccacacacaaccggccagggccacgtggccgcgggcgcttaaaccaccgcccgcggcacgggggacaacaagcgggaacaccagggagaacacaagcggaaaagagaacccaaacacaacaggcggaggcgcacgaccctagacacggcgcggcccacgcacccgccccccaccccgcagacaccaacacacgcacacaacaagcgcgacccacctcctccacaaaggccacaacagccgcagtcccctacccgcgggcgggcccacccccaccacacccgcggcgccgactacgacacaaagagcccgaagcacgggagcgacaaccgaacatacacgggcgacacacccccgggggccgcactcgcgcaccgcccagagcgcacgacacccgcgaaataccaaccagacgagggcgcacacccgcacacagcgccgcaaccc

SEQ ID NO: 324184 - DNA, 2435 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgaaaaaaaaaacaaagaaaaaaaaaaaaaaaaagggggggcgcgcaccagagagagaaatctcccccgagaggggccccactgtcaagagcggatccccgcgcaaccgggagcaacaagggggcccaaggcggagaggagccacacacaaccggccagggccacgtggccgcgggcgcttaaaccaccgcccgcggcacgggggacaacaagcgggaacaccagggagaacacaagcggaaaagagaacccaaacacaacaggcggaggcgcacgaccctagacacggcgcggcccacgcacccgccccccaccccgcagacaccaacacacgcacacaacaagcgcgacccacctcctccacaaaggccacaacagccgcagtcccctacccgcgggcgggcccacccccaccacacccgcggcgccgactacgacacaaagagcccgaagcacgggagcgacaaccgaacatacacgggcgacacacccccgggggccgcactcgcgcaccgcccagagcgcacgacacccgcgaaataccaaccagacgagggcgcacacccgcacacagcgccgcaaccc

SEQ ID NO: 324185 - DNA, 1691 bp, Homo sapiens
cctcagtagacacaggcgcctggtgtattagtacgtgctgcggtttgcttacatcgttgctggctctcgttcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324186 - DNA, 1927 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgattacaatcaactggccgtcgtttcaaccgttggatgggcctggcgttcccaactaatgccttgcagctcccctt

SEQ ID NO: 324187 - DNA, 1775 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcgggctagtcgggggggtaccgggc

SEQ ID NO: 324188 - DNA, 1681 bp, Homo sapiens
  misc_feature (192)..(193): n is a, c, g, or t
  misc_feature (198)..(198): n is a, c, g, or t
ggtggaccacatgatgctcaccgctctggaggcccggcggctagaggaggctcggtggtccagaagaggaggggctgatgtgaacatccggcattcaggccgcgatgacacctcccgctacgatgagaggcccggcccctccccgcttccgcacagggaccgggaccgggaccgtgagcgggagcgcagagnncgganccgggagcgatacaaggagcgagaacggcgacgctcccgctcccgggaccggcggaggcgctcacggagtcgcgacaaggagggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324189 - DNA, 1357 bp, Homo sapiens
ctcggtacccagttcgacggagactctccgaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324190 - DNA, 1404 bp, Homo sapiens
actgtctccagatgatccttgacactagggcacttctatctgcattcacttctccacctcccctttctcctgacagagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324191 - DNA, 3354 bp, Homo sapiens
  misc_feature (1964)..(1964): n is a, c, g, or t
  misc_feature (2035)..(2035): n is a, c, g, or t
caagtacctattggatcaccagctgtgtgccgggcttctagttgagcaacacagaggcagcctctgccctctgagcctcctgcattcggtctcctcattgtcatttgctgtctcaggcaaggtcagtttggctgcaagtatcagaaataaacttgagcttcctgaaacataaagggccctgttgatgtagaatcatgggcatcctttggagttcggaggtatgtgatgtccgtggacctgagaacctggtagctgacgctgttaagagctggggcaaccaggccaggcgtggtggctcgcctgtaatcccagcactttgggaggccgaggcgggtggatcatgaggtcaggagttcgagaccagcctggccaagatgttgaaaccgcatctctactaaaaatacaaaaattaactgggcgtggtggcgggtgcctgtaatcccatctactcgggaggctgaggcagagaattgcttaaacctgggaggcagaggttgcagtgagccaagatagagtcactgcattccatccagcctgggtgccagagcaagactctgtctcaaaaaaaaaaacaaaaaacaaaaaaactggggcgacccacctgtgatgtgtgacagcccacagcttgcttctgcctcgtttgcctccatgcagctaggtcggtcccatgcctctttgcactggcccagtgcagcaggccacaggccccagctttacactcagtcctggatgagtctcttgtttcggggtgggcacatttgattgactcagtgttgggcctggggtcctgttgctcaggcatgcttattgaggactgaatcctgcaaagctgagtgacagttgtcagagaagatgatggtccctgggcagacacccaggcagtagtagccacttggggctcctgtcctgcctcccagccctgtgtcctggctctggactcgcctgtgctagggagaccacgctctcagctgctgagcctcggagcttaccaggcatgttcttaccttactctggtctctctggggtggagtgggttcttatagctctgctgtttcctgttggggcgggaaaatgctagaatctcagtctttccagaatctcagaatcttctagttcaattgccattcaaactttttgttggtgttagccaataacatcttgactcggtgcacccgcagaaatactgtaacctaaagtttgaggaaacagttttttctatgtagtaagtatatagttgtattctgctgttttgtttcttaagatgttggttgcaacccatcagattgatgatgggactcatttctgggtcatgacctgaatataggaaaggctagtctagctgccctgtgcctgtgacatggcaggtgcctggtccgctgcctgcttctataagaatgtctccctgcagcctcttttctatacagaactcagccctgcctcacggaagcttttccaggcagtgcgagatagaggagcgcttgagaaggcaggttttgcagcagacggcagtgacagcccagttctgcaccttctttgctgagtcactgtgggccagtgacttgatctgagattgtttccccatcagaaccatgaggttatcatctgtgccttggggctgttcatctatctattcacttgacacacacacatccacctttctataccagctgcagcgccacctgctggtaccgtgagcaagagctgggcatgcccacggttccggtgccctgcagtctggtgggagaggcaggtaggggtcgactcaggtagcaaacctgaaactccaggggaaggaagcgtttctgcaactgtgagtacataggactgtgaggagagacttcccgagaaaggatgttcgggctagcgttaagggtgagcgtgagttcaccagagaaggaaggggagaccagtccagggcaaggagaatgcacagacactggcaggaaggtgagcgtggggacacngggaaaggcctgggacacgcagccaagagccgcggctcagacgctagcagggcccgctcttgctgcctctnccaccagttgacgaggagtttggaccttaggctgggggacgccagcaaaggcttctaagcagatcacatttttgggtggaaagatcattggcttcgggtttctgtgagggcgaggatgattggaagggagggttttgaggaggctgtgaagtgcgctatggttaagatgatgcgctttggggccagacatgggttccagtaacggctgttgcctagcgaacgctttgtgtgagttaattagagaagacgtggctgtcttgtgatgggagtgcgcgggatgaactgcacggggggacccggccctgtgaacactaagccaggggctgccttcctgccctttgctcttggagtcggctcatttctgctcctccgggccctgtccctgcccagattcaccctctgtccgtctgccctgccccaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324192 - DNA, 3327 bp, Homo sapiens
  misc_feature (1964)..(1964): n is a, c, g, or t
  misc_feature (2035)..(2035): n is a, c, g, or t
caagtacctattggatcaccagctgtgtgccgggcttctagttgagcaacacagaggcagcctctgccctctgagcctcctgcattcggtctcctcattgtcatttgctgtctcaggcaaggtcagtttggctgcaagtatcagaaataaacttgagcttcctgaaacataaagggccctgttgatgtagaatcatgggcatcctttggagttcggaggtatgtgatgtccgtggacctgagaacctggtagctgacgctgttaagagctggggcaaccaggccaggcgtggtggctcgcctgtaatcccagcactttgggaggccgaggcgggtggatcatgaggtcaggagttcgagaccagcctggccaagatgttgaaaccgcatctctactaaaaatacaaaaattaactgggcgtggtggcgggtgcctgtaatcccatctactcgggaggctgaggcagagaattgcttaaacctgggaggcagaggttgcagtgagccaagatagagtcactgcattccatccagcctgggtgccagagcaagactctgtctcaaaaaaaaaaacaaaaaacaaaaaaactggggcgacccacctgtgatgtgtgacagcccacagcttgcttctgcctcgtttgcctccatgcagctaggtcggtcccatgcctctttgcactggcccagtgcagcaggccacaggccccagctttacactcagtcctggatgagtctcttgtttcggggtgggcacatttgattgactcagtgttgggcctggggtcctgttgctcaggcatgcttattgaggactgaatcctgcaaagctgagtgacagttgtcagagaagatgatggtccctgggcagacacccaggcagtagtagccacttggggctcctgtcctgcctcccagccctgtgtcctggctctggactcgcctgtgctagggagaccacgctctcagctgctgagcctcggagcttaccaggcatgttcttaccttactctggtctctctggggtggagtgggttcttatagctctgctgtttcctgttggggcgggaaaatgctagaatctcagtctttccagaatctcagaatcttctagttcaattgccattcaaactttttgttggtgttagccaataacatcttgactcggtgcacccgcagaaatactgtaacctaaagtttgaggaaacagttttttctatgtagtaagtatatagttgtattctgctgttttgtttcttaagatgttggttgcaacccatcagattgatgatgggactcatttctgggtcatgacctgaatataggaaaggctagtctagctgccctgtgcctgtgacatggcaggtgcctggtccgctgcctgcttctataagaatgtctccctgcagcctcttttctatacagaactcagccctgcctcacggaagcttttccaggcagtgcgagatagaggagcgcttgagaaggcaggttttgcagcagacggcagtgacagcccagttctgcaccttctttgctgagtcactgtgggccagtgacttgatctgagattgtttccccatcagaaccatgaggttatcatctgtgccttggggctgttcatctatctattcacttgacacacacacatccacctttctataccagctgcagcgccacctgctggtaccgtgagcaagagctgggcatgcccacggttccggtgccctgcagtctggtgggagaggcaggtaggggtcgactcaggtagcaaacctgaaactccaggggaaggaagcgtttctgcaactgtgagtacataggactgtgaggagagacttcccgagaaaggatgttcgggctagcgttaagggtgagcgtgagttcaccagagaaggaaggggagaccagtccagggcaaggagaatgcacagacactggcaggaaggtgagcgtggggacacngggaaaggcctgggacacgcagccaagagccgcggctcagacgctagcagggcccgctcttgctgcctctnccaccagttgacgaggagtttggaccttaggctgggggacgccagcaaaggcttctaagcagatcacatttttgggtggaaagatcattggcttcgggtttctgtgagggcgaggatgattggaagggagggttttgaggaggctgtgaagtgcgctatggttaagatgatgcgctttggggccagacatgggttccagtaacggctgttgcctagcgaacgctttgtgtgagttaattagagaagacgtggctgtcttgtgatgggagtgcgcgggatgaactgcacggggggacccggccctgtgaacactaagccaggggctgccttcctgccctttgctcttggagtcggctcatttctgctcctccgggccctgtccctgcccagattcaccctctgtccgtctgccctgccccaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324193 - DNA, 866 bp, Homo sapiens
ggacgcgtgggtcgacccacgcgtcgcggacgcgtgggctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttga

SEQ ID NO: 324194 - DNA, 1070 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagcccgcacatccgacagcccggacagca

SEQ ID NO: 324195 - DNA, 1059 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctttaagccccatggtcccgctagcgcatgtccataagggatcagctgaacg

SEQ ID NO: 324196 - DNA, 1187 bp, Homo sapiens
gcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgaatcccctcccccaaccttggccacttgagtttgtcctccaagggtaggtgtctcatttgttctggccccttggatttaaaaataaaattaatttcctgttga

SEQ ID NO: 324197 - DNA, 2322 bp, Homo sapiens
gatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggaggagcctcggtgtaccagaagaggtgggaggagggaaggtaccgagcc

SEQ ID NO: 324198 - DNA, 1135 bp, Homo sapiens
taaaataatttttttctttcactgttctggggaagtctgtgagcctgtaagggatcaaatgttatagaggtctaaatatgtgatgccagggcagaaagtaaggataaaaagtttcagggaaaggaaagcaaagaaaatcaggaacaaatgagaataaagattagttaaaaatgattactgcatatcttatgcacatatacccattttaattaagcatctggtgactttccttttaaggtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgag

SEQ ID NO: 324199 - DNA, 7424 bp, Homo sapiens
  misc_feature (498)..(498): n is a, c, g, or t
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacanttcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtgtaagttgtaaatattacatttcaaaccaatttcaaattattttgcaaaagttcctaaatttgtaaacatacatattgctgtatttaaattccatatatttagccccattacactaggtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgtttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 324200 - DNA, 759 bp, Homo sapiens
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggcaagtactgatttaaataactccaagattgaccgatactttgatttatctttctaactaaaatgggagttaaggtatttagatgatttccttggattctttgacattagctacagtaatcttttgctaaacttaatgtttttttttttttttagaacttatttttgaaaaactttctggtcttgaggttaagaagtagattaatacagtgtgtattttttttatatcatgtcatcattagctctgtttctttcattataattttgggggcaattccttttcacttttgaaaatccatattgaagaccatggccattattt

SEQ ID NO: 324201 - DNA, 5332 bp, Homo sapiens
  misc_feature (498)..(498): n is a, c, g, or t
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacanttcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgag

SEQ ID NO: 324202 - DNA, 7389 bp, Homo sapiens
  misc_feature (498)..(498): n is a, c, g, or t
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacanttcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgtttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 324203 - DNA, 5480 bp, Homo sapiens
  misc_feature (498)..(498): n is a, c, g, or t
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacanttcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtgtaagttgtaaatattacatttcaaaccaatttcaaattattttgcaaaagttcctaaatttgtaaacatacatattgctgtatttaaattccatatatttagccccattacactaggtaagataaaatttttataaacttaccttagtgattgatatctcaataaactatcttgtacatttttacaggtgcaggcaaatctttataaatgaataccaaatagtatattatttcctatacagactttatgatatctaaagaaatcataaggtatttttaaataatcaccacacattgaccaggttgccttgtcattccacactacaatttttttttaaatgtttctcattagcaccttttcctttaaaaaaaggaaaataggtcttatgcttctgcttttattctttgaacttgtagtaggaaagtaacaggtaccattttttaaaaattatatccatagaaattaacacatgttggtctcaagtgtttgatatcttgattttgtttgttttctaacccagttcatttatctacatcaacatgtatatagttttagatgttcacacaaacacatttataagagaggtacagtaagaatctgtacctcaaattttagtgtcaccagagtatcactgctgtaatttgcagatctgacagtgttttttctccttagttatgtgagtggaaatagagtagcatgtcttctattagtcagaaatttaacactttttctgagagtaatcccacccatacataattacatcatggctcgacttttcagagttgccaatgtactgtcattaaatactcaattatcttagagattttcctattcctgtgtattccacaggaagaggaaaagttgcctgggtgtctagccagtacttcatgccatcttccatgtaatttttctatcaggttaaaagtaaaggtaagtacatttttgtggcagctttataaatgtgtttggattcaaccaaatcactatttctaaacaaaggattcttaaggaatcctttatttaataaaatacacatgaatgatgtaacaaggaaataacaaacctcataattttagtttgtttatatttggacatcataaaattcagggtttaaatgattattgtgctctcctaaaattacacaagtcctatgaatgttctaaaccaaacaagtatttctt

SEQ ID NO: 324204 - DNA, 3246 bp, Homo sapiens
taaaataatttttttctttcactgttctggggaagtctgtgagcctgtaagggatcaaatgttatagaggtctaaatatgtgatgccagggcagaaagtaaggataaaaagtttcagggaaaggaaagcaaagaaaatcaggaacaaatgagaataaagattagttaaaaatgattactgcatatcttatgcacatatacccattttaattaagcatctggtgactttccttttaaggtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgtttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 324205 - DNA, 7443 bp, Homo sapiens
  misc_feature (498)..(498): n is a, c, g, or t
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacanttcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgtttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 324206 - DNA, 2060 bp, Homo sapiens
ttttaagacactctagctgaaaagtaagagtgcaaatgtacccttttatcccagataagtttttaaaattaaaaactataataaaagcaaataaatacagttctggtgtatttaagagctgtatattttaggtacatatctaggacaacattagataacagatttttttgtttcattcctcaaaatatgtatactcacaatttcataaccataaattgtgatttttttttcccctagtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagaggtaagcatgtgtaactctaaactgcatctgtttcgttactatattataaatcataatttgatgctatccacatttgggtcttccccaaagcagagcagaatctcctgaatctagtgcaattgaatccacacagtccacaccacagaaaggacgaggaagaccatcaaaaacgccatcaccatcacaaccaaaaaaaaatgtgtaagttgtaaatattacatttcaaaccaatttcaaattattttgcaaaagttcctaaatttgtaaacatacatattgctgtatttaaattccatatatttagccccattacactaggtaagataaaatttttataaacttaccttagtgattgatatctcaataaactatcttgtacatttttacaggtgcaggcaaatctttataaatgaataccaaatagtatattatttcctatacagactttatgatatctaaagaaatcataaggtatttttaaataatcaccacacattgaccaggttgccttgtcattccacactacaatttttttttaaatgtttctcattagcaccttttcctttaaaaaaaggaaaataggtcttatgcttctgcttttattctttgaacttgtagtaggaaagtaacaggtaccattttttaaaaattatatccatagaaattaacacatgttggtctcaagtgtttgatatcttgattttgtttgttttctaacccagttcatttatctacatcaacatgtatatagttttagatgttcacacaaacacatttataagagaggtacagtaagaatctgtacctcaaattttagtgtcaccagagtatcactgctgtaatttgcagatctgacagtgttttttctccttagttatgtgagtggaaatagagtagcatgtcttctattagtcagaaatttaacactttttctgagagtaatcccacccatacataattacatcatggctcgacttttcagagttgccaatgtactgtcattaaatactcaattatcttagagattttcctattcctgtgtattccacaggaagaggaaaagttgcctgggtgtctagccagtacttcatgccatcttccatgtaatttttctatcaggttaaaagtaaaggtaagtacatttttgtggcagctttataaatgtgtttggattcaaccaaatcactatttctaaacaaaggattcttaaggaatcctttatttaataaaatacacatgaatgatgtaacaaggaaataacaaacctcataattttagtttgtttatatttggacatcataaaattcagggtttaaatgattattgtgctctcctaaaattacacaagtcctatgaatgttctaaaccaaacaagtatttctt

SEQ ID NO: 324207 - DNA, 686 bp, Homo sapiens
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaaggtgagtaaaattctattcttttttacatctgtgtagggcagaggtcccctgtggaaatcacatggggctataatgtatcttgttggggtaacttaaaaaagcaaagcaaagcagcaaatggcatagaaaagatctaagggagtagagtatataaggtacagtggggattatttggctatgattaaagggacagcaattaggtgaagcttagattttctaggatctcctatacttgggtataaagaacaagtctacaatactcatattccttattgtctatacaaagttgtctcctttcttctatatagtttctaaagacaaccactttaagggagttttaggtctttatactgagtaattaggctgtgtactactttcttgtaagttattttcaaagtaggtcaaagggcttcactttaagcttcttcctctgcttctgacatgtagtaatg

SEQ ID NO: 324208 - DNA, 5818 bp, Homo sapiens
tatccagtaatttcaatacagtgtattgactagtctaccttttccctgattacttgaaatattacctttttcatatgctaaatccttaattcagtctttttttctgggcttgttcaattcttacagtttgtttattccagcgtcagtactacatggttttaattattgttggttcttaatattttaacataatgatttgtttaaatgtacttttgtaatactgaaataatctgtattacagcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacgtttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgtttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 324209 - DNA, 4275 bp, Homo sapiens
  misc_feature (498)..(498): n is a, c, g, or t
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacanttcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagacctgctaatacttttcaaggacgattacttggccaaaaaaaatgaagaaagaaaacaaaagtaagggggaagctaaattaagagctaaacaggagcaagaagcaaaagaaaag

SEQ ID NO: 324210 - DNA, 1020 bp, Homo sapiens
caggcccatccttctgtggtcagtcactgctggttggggaaggaaggagagacacaaccgcttcagatgggcagtgaaaaagacgatggaaaggccaggacaccacggaagttctgaaggggtagtgggaaccgagggtgaatggaaagcagccctttgacagaagaaagacagagaccagtttccagtgagctcctgaggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagtgaaaatacctaactctgcattctgtgaaagggagagagttgaaatgaggcacagctgaagtttcaccactccattattctgccatcaagcatcccttcagctcccatctctcaaatgctgcagccccatcaatggaaaaaaatacattcatgggaattgcacaaagtttacaacacatgcaaattccaaggagctcagagagaggtgtgggggtgagatggtgtgactacacccccttcttctaggatgcgccgaaggattctttttcttgctcatatgctgttagaaagcctgggcgtttacgtctgctggagctggagctaatgtgatttctaactgtctaataaaattccactgcttgcaaaa

SEQ ID NO: 324211 - DNA, 489 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggtaggtaagcgccgggcgcggcgcccgctttcccgcagtccggagccggagagccagcgaggcggcgaggcagcccccgcggcttgcagcggagccgacagctcgtcttctcttctggaggtgcagctg

SEQ ID NO: 324212 - DNA, 686 bp, Homo sapiens
ttttttttttgtttttgtttttttttttttttttagccatataaggtaacattcacacattcaagggttaggacctggatatcttctagaggaggattgttcaacctaccacacatataaagacaactggagccccaaaagggcagagacttgtccaagatcacacttccagatgacaacaaaaatcaaagatccaggtctcctttctgtccatttaggcttcttccactagaccgaggtgatgcccaccgaaggcggacagagaaaaagtaaaattgtgcttcataccctaatctgtgtgctttattcgtttgtcttctttatggatcaggtgctaccaggattcacccacctttgaggcttcttcccccttgagtcttggtaaccttacactgagctcacactaagctggcctgtgtgggcagctgcaatcaaatgacccaaatggcattttcttctctcctttcaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacaggtagcctcttctctcctcctctttcctgaaagtgaagaaaataaaggatgcttcagacactt

SEQ ID NO: 324213 - DNA, 354 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccgtttttgtcctctttttttctaccaacctatttctctttgggactcatatttttcgtcatgcatggatttg

SEQ ID NO: 324214 - DNA, 199 bp, Homo sapiens
caggcccatccttctgtggtcagtcactgctggttggggaaggaaggagagacacaaccgcttcagatgggcagtgaaaaagacgatggaaaggccaggacaccacggaagttctgaaggggtagtgggaaccgataacatgatttcttactcattttctttttcaaaatgatgtttgatgagcaccgattttacagag

SEQ ID NO: 324215 - DNA, 3579 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaag

SEQ ID NO: 324216 - DNA, 1757 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcaggtgggtaacagtgacctgaagacatactaacaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagtgaaaatacctaactctgcattctgtgaaagggagagagttgaaatgaggcacagctgaagtttcaccactccattattctgccatcaagcatcccttcagctcccatctctcaaatgctgcagccccatcaatggaaaaaaatacattcatgggaattgcacaaagtttacaacacatgcaaattccaaggagctcagagagaggtgtgggggtgagatggtgtgactacacccccttcttctaggatgcgccgaaggattctttttcttgctcatatgctgttagaaagcctgggcgtttacgtctgctggagctggagctaatgtgatttctaactgtctaataaaattccactgcttgcaaaa

SEQ ID NO: 324217 - DNA, 2660 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcaggtgggtaacagtgacctgaagacatactaacaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaagggcacaggattttccattcaaggttgtgcttgtgaagggatgagagagctgtagaattctttgcagccagagttggacaaagccaaatggctaaactcactgtttgctcattggaaaaaccaacaagtgtggttagtccttgctctgctcctaactttctatcactaatcaaatcacttaacttctaagttattttcatgtcatatgaaaaagagtaaaggccaccttaatctcttctaatctgt

SEQ ID NO: 324218 - DNA, 3446 bp, Homo sapiens
ttcagaggctgttgaaataatccaggtgtgagataatagtgacttggaccaggtgaggtcagcaaaggtatggaaaggatgtgatctgagatatattttgaaggcagaaagggcagatgttgctgatggataagatatggggcacctgagaattacaggcgtcaaggatggcccctcagggtttttgagctggtctaggaggtcagagagggctccttggtcggtatgcttgagctgagaggccaaggaggacaggattggttcggtgaggaagggagagaagtctgaagcagaaggaacagtagaagcagcccggcactgtcattctttgatgtaataaatttcctccagatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcaggtgggtaacagtgacctgaagacatactaacaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaag

SEQ ID NO: 324219 - DNA, 2472 bp, Homo sapiens
ggcattgcagagacttcatctggggtgtcataggaaagcagagataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaag

SEQ ID NO: 324220 - DNA, 1552 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcagattgatctggagccagaaggaagagtgtatgtgatcatcgatctctcagggtcgtcgggtgaagtgaaaatacctaactctgcattctgtgaaagggagagagttgaaatgaggcacagctgaagtttcaccactccattattctgccatcaagcatcccttcagctcccatctctcaaatgctgcagccccatcaatggaaaaaaatacattcatgggaattgcacaaagtttacaacacatgcaaattccaaggagctcagagagaggtgtgggggtgagatggtgtgactacacccccttcttctaggatgcgccgaaggattctttttcttgctcatatgctgttagaaagcctgggcgtttacgtctgctggagctggagctaatgtgatttctaactgtctaataaaattccactgcttgcaaaa

SEQ ID NO: 324221 - DNA, 921 bp, Homo sapiens
caggcccatccttctgtggtcagtcactgctggttggggaaggaaggagagacacaaccgcttcagatgggcagtgaaaaagacgatggaaaggccaggacaccacggaagttctgaaggggtagtgggaaccgagggtgaatggaaagcagccctttgacagaagaaagacagagaccagtttccagtgagctcctgaggtcaccctagagaatcctttacttacctgtgctgaaaaaaatgctcccatcagttaccctatgatgaggtctccagccctttcatcagaagacagagctttaaaatgcaggtgggtaacagtgacctgaagacatactaacaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagagtgacttgcccatggccagaggctacaagaggctccagcaaaccctgccagagaggagtgactcactgaatccacagaccacgtctaatggcagggaactccacaaagaatgctctccgttcatttattgcttgatagacacctctaatgtataaagggctatgttgaaatttaggattccctcgggctatgcctgtcaccgaggactgagtgctcctgccatggagaggcaggtgggccaggtggcctgggctcccgcaaaatgggtgaggcaagaccccctcagagcagtaactccaggaaccacttgcctccacctgccagccctgcctgcacctcgc

SEQ ID NO: 324222 - DNA, 464 bp, Homo sapiens
attcaccatttttctgtgggcactagctgatgcacttggacaaaagagaaaaagagggtgaatggaaagcagccctttgacagaagaaagacagagaccagtttccagtgagctcctgaggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcagcaccagtactggccccatctgcagcggattatttcttccttcctaaaaatccaggctgcttcttgccatgtggagacaatgagctccttaaccaagggtgaaaaagaccaaccaaatcaaaacaaaa

SEQ ID NO: 324223 - DNA, 424 bp, Homo sapiens
ttgcctgtttcattcttgactggacatacatattgccccattgtgatgaaaggttgtgataatgaagagagtaatagaaggctcagctcaggttctaaggagggagcgagtaaaggccatgcaggcccatccttctgtggtcagtcactgctggttggggaaggaaggaggtatcaagtgtctccattctttcctcttttcttcatagtttctagatcattcatttaataaatcattagggagcccctgccatcaagctaggtcttgggatataaccaggaacatgcctagataggtaccctaatctcagagggctcatgctccaattgggggacagatactcaaacaggcaattatgacatagttcataaagccctgtgatgtatgccaccagagtacccaaaagggccccaaactagacatg

SEQ ID NO: 324224 - DNA, 4000 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcaggtgggtaacagtgacctgaagacatactaacaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaag

SEQ ID NO: 324225 - DNA, 1367 bp, Homo sapiens
ggcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcagcctctctaattctctgagacaaaatgatattgaaatcaggccacttaataaccctacaatgacctctaagtgttccagtgaaaggaagtctcagagctctcacttgaaatcaaaactagaaatgatgaagcttagtgaggaaggcatgttgaaagctgagacagctgaaagctaggcctcttgcaccagacggccaagttgtgaatgcaaaggaaaagttcttgaaggaaattaaaagtattgctc

SEQ ID NO: 324226 - DNA, 3216 bp, Homo sapiens
attcaccatttttctgtgggcactagctgatgcacttggacaaaagagaaaaagagggtgaatggaaagcagccctttgacagaagaaagacagagaccagtttccagtgagctcctgaggatattcaagtctgtgcttctgcttgactgaggatcatctaggaaatgaaactaaacttggcttcgacctagaccttgtgtgaccttgaggtcatcaccctctcacagtcaccctagagaatcctttacttacctgtgctgaaaaaaatgctcccatcagttaccctatgatgaggtctccagccctttcatcagaagacagagctttaaaatgcaggtgggtaacagtgacctgaagacatactaacaggggctggtgagggtcagcactagtggtgagaattctggagaacattttctttacccagaaacttaaaatcatggactcttggggagaaaggaatgagaaaaggcagcatgcggaattaccagtttgttatttggttcccatctggatttaaaaccgaagatcccaaactcagattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaag

SEQ ID NO: 324227 - DNA, 704 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatc

SEQ ID NO: 324228 - DNA, 600 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtga

SEQ ID NO: 324229 - DNA, 472 bp, Homo sapiens
cctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtga

SEQ ID NO: 324230 - DNA, 469 bp, Homo sapiens
taatctactcatggtatgtggataggaattaaattgtaggggcattcacttgatggcattcattcttagaacatttacctatgtctagcttttggagtaaagtcacataacctctaaccaggtaagtttcctgtggctttatttaggattttaaatactcattttcagtgtaattttgttatgtgtggattaagatgactcttggtactaacatacattttctgattaaacctatctgaacatgagttgtttttatttcttaccctttccagagcgatgattctgacatttgggatgatacagcactgataaaagcatatgataaagctgtggcttcatttaaggtatgaaatgcttgcttagtcgttttcttattttctcgttattcatttggaaaggaattgataacatacgataaagtgttaaagtacatgttattcagttttcattttgaagattaaggatagag

SEQ ID NO: 324231 - DNA, 296 bp, Homo sapiens
ggacggggccccacgctgcgcacccgcgggtttgctatggcgatgagcagcggcggcagtggtggcggcgtcccggagcaggaggattccgtgctgttccggcgcggcacaggccaggtgaggtcgcagccagtgcagtctccctattagcgctctcagcacccttcttccggcccaactctccttccgcagcctcgggacagcatcaagtcgatccgctcactggagttgtggtccgcgtttttctacgtcttttcccactccgttccctgcgaaccacatccgcaagctccttc

SEQ ID NO: 324232 - DNA, 1815 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324233 - DNA, 1687 bp, Homo sapiens
cctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324234 - DNA, 1945 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324235 - DNA, 1459 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324236 - DNA, 1188 bp, Homo sapiens
gcgaaatcgtggtctggcatacttctctgacaactcaagggccagacacattcctgtagcagtgaccaagcccgatctgggcccatggccttagctaacagaagtgccacattctccacattgatgggggaaggcccatcactgaggctcccatttagtgactcctggggggctggcctcgtgctcttgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324237 - DNA, 875 bp, Homo sapiens
  misc_feature (8)..(8): n is a, c, g, or t
actcgtcnaccggactgcggcggtgtggagattcggcgtgtgcagtttggattttcggcgtgtgcatgcacacgccgagtacccagcccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324238 - DNA, 1318 bp, Homo sapiens
tgactgtgggccttatgcagcaaaagcctatactcattagttcccagaaaatttagcatcttaatggtattttaatctgaatctcttttggtggagctagttaccaataagtcatccatgtgttggataatcgtgtcttatttaattgtaacattcttaattctctagccaatgcatttccagacaaatgagggctatccctaaacccttggggaagaaaccgtccaagttaatgactaccagaatcagtctattcaaaagcaacgatgaattgtgaatcagggtgtactggaatgcacaaaaaacggcatcctttgccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324239 - DNA, 862 bp, Homo sapiens
gtaaccacgttctcctgatcaaatatcactctcctacttacaggactcaacatactagtcacagccctatactccctctacatatttaccacaacacaatggggctcactcacccaccacatttacaacataaaaccctcattcacacgagtaaacaccctcatgttcatacacataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324240 - DNA, 1144 bp, Homo sapiens
aagctatctatatatagctatctatgtctatatagctattttttttaacttcctttattttccttacagggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324241 - DNA, 1988 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattaacacacacaaaaaaaaaaaaaaaaacgcacccaaaaagaacagatcaaacaagaacaaagcaaaagaaacaacacaggagggggcgcgcgtcaaaagatatcacccgagaggggcgaccatgttgagcgtgcgccaccacagtattgtgtcaacaagggggccccacaaggaggaggcgcatcattatacacacgacacaggggcgcgcatataaaaaaacacgaccgggggacgggggagaaaacaggcgtggcccgagaaacaactcgggggagaagaacccccccaacaccatcggggggagggcaaacaaaaaggggagcaacaacaccacaagaagaaagaaataaaaaagcccccggaggggaaataacagacagacagagagacaataacatgcggcgaacaacacgggacgataagcggcgggcgatagaaaaatgtcgccgcaacggcagaagtaagagaaaaaaagaaataacgcgg

SEQ ID NO: 324242 - DNA, 1356 bp, Homo sapiens
  misc_feature (1356)..(1356): n is a, c, g, or t
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagaaagagtgctggcggtaccgagccgan

SEQ ID NO: 324243 - DNA, 973 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattacta

SEQ ID NO: 324244 - DNA, 790 bp, Homo sapiens
tgactgtgggccttatgcagcaaaagcctatactcattagttcccagaaaatttagcatcttaatggtattttaatctgaatctcttttggtggagctagttaccaataagtcatccatgtgttggataatcgtgtcttatttaattgtaacattcttaattctctagccaatgcatttccagacaaatgagggctatccctaaacccttggggaagaaaccgtccaagttaatgactaccagaatcagtctattcaaaagcaacgatgaattgtgaatcagggtgtactggaatgcacaaaaaacggcatcctttgccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagaataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattacta

SEQ ID NO: 324245 - DNA, 252 bp, Homo sapiens
ccctccaccaccccccatgccagggccaagactgggaccaggaaaggtaaaccttctatgaaagttttccagaaaatagttaatgtcgggacatttaacctctctgttaactaatttgtagctctcccatgaaacttttgtagcttaaatacacaagaattttttgaaaaggaaataagataatgatgcaaaatagttaattttttaaaaaaatgttagacactgcagtggatgcaacaaaatactttatat

SEQ ID NO: 324246 - DNA, 510 bp, Homo sapiens
tgtttattggaattattaataattttggagatgggaaaagagcatgactgtttgactttgtaggtggaaatcaacgagaacttgcccgccagaaaaacatgaagaaaacccaggaaattagcaagggaaagaggaaagaggatagcttgactgcctctcagagaaagcagaggtacgtggtactaatttaattctaaagtcactgacgttgtgattgaagcaacattttgggctgggtgtgttgcctcatgcctgtaatcccggcagtttgggagagtcgggagaactgcttgaagccaagagtttgagaccaacttggacaacatagccagcccctgtatctacaaaatatttttttaaattggccaggcatggtagcacatggctgtggtctcggctactctggaggctgaggcgggagaatcgcttgagcccaggaggttaaggccgcagtaagctgcgattgcaccactgcactccagcctggatggcagagttagaccctgtctc

SEQ ID NO: 324247 - DNA, 963 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagggactctgagatcatgcaagaaaagcagaaggcagctaatgagaagaagtctatgcagacaagagaaaagtgatgactggctatttggaaaacctgggtgctactgccaactgggtgtatcataagctctaagatcaagattttgtagagtggacagtcattacatatgttataacttatcctttaaaaactattttaaactttatcctttcagctttacttagtgcgatgttttagaagcagtcttcaaagaataaaacactaaccatgcatgtgacatattggtgaacattatttttattattgaacattcatatataatttattaggtaatatgatcagataataggatctcttatataataaagaatctttgtcatcagctttgttaacatagtttttttttcctcacagtttctaaggataaggataaagtagatctttgaagtaaacttaaatatataatagaagttagggtccatttgtataattttgctttgaaatcaagttaaagggccaggtgcggtggcttatgcccacaatcccagcactttgggaggccgaggcgggcggatcacttgaggtcaggagtttgagaccagcctgaccaacatgatgaaacctcatctttactaaaaat

SEQ ID NO: 324248 - DNA, 1501 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324249 - DNA, 1447 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324250 - DNA, 1414 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324251 - DNA, 1360 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324252 - DNA, 1274 bp, Homo sapiens
ggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 324253 - DNA, 659 bp, Homo sapiens
acgcgcagtgacgcgccggccatgccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagaggtacgtggtactaatttaattctaaagtcactgacgttgtgattgaagcaacattttgggctgggtgtgttgcctcatgcctgtaatcccggcagtttgggagagtcgggagaactgcttgaagccaagagtttgagaccaacttggacaacatagccagcccctgtatctacaaaatatttttttaaattggccaggcatggtagcacatggctgtggtctcggctactctggaggctgaggcgggagaatcgcttgagcccaggaggttaaggccgcagtaagctgcgattgcaccactgcactccagcctggatggcagagttagaccctgtc

SEQ ID NO: 324254 - DNA, 6234 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324255 - DNA, 6320 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaaggaatgaatggagaatccatgatgtaaccacagcccccttccctgggcttgttcagaggcggtctcgcctgctcattgtgagccaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324256 - DNA, 5944 bp, Homo sapiens
tcgaatcgtaaccgttcgtacgagaatcgctgtcctctccttgctcgagatccattgtgctctaaagaggaaacgagccaagaggcatccctggaaccactctgctgggagctgctccgctgaaagcctgggtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324257 - DNA, 5930 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324258 - DNA, 889 bp, Homo sapiens
gagctcggtacctaatctgtactcattgcgacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324259 - DNA, 4245 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagtagctgggattacaggcatgcgccactatgcccagctaattttgtatttttactagatacggggtttctctatgttggtcaggctggtctcaaacttctgaccttgggtgatccgcccgcctca

SEQ ID NO: 324260 - DNA, 849 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagaggaggagcaggagccacgcctatggtcgcatgttgctaaccatctcgaggtcaggaagatgctctgtgagacggagtgggtcagatgccaaagaaaacacaagcttgtcagcggtgatgtctccctgcaaaggcagccgccaccagcttcctgccgagatgggccggctcagcctcacttgctacagctggagatggagaggaccagatggccctgtttggcccagattccagccagattgccagggaggtgtaggcggagcagcggggtcggcgccaggagcagggatacgtgagtgaggagggcgggagccacctctttgccatctcagtagggccctgcctgtgtagggggtggcggggcaccgactgtggccttacagtggtctgtgaaccagcatatgctcagagctccctggagggagac

SEQ ID NO: 324261 - DNA, 303 bp, Homo sapiens
tgaggaacgacgccgaggaaggtaggcccctctgtgccttggcggccacgcagctgccttggcctctgatcagggtttggaatccaggttctgtgcagtagacgtgtgggcaaggcaggtctgcagacccacttccaagttccagcagccccattcctcttaggaagtggacgttcctaggaacttcgaatttatcttagacttcttttttttctaagacagggtctcgctctgtctcccaggctggagtatagtggcgcgatctcagctcgctgcaacctctgccacccaggctcaagtgat

SEQ ID NO: 324262 - DNA, 407 bp, Homo sapiens
caggtggctactggctgctgcattaggcagcatagccagaccttgctgatacttacagggccactgtaaggatttgcacttctcttgaggagcaatggaaggaaaacctcaaaagcgtttcgaacacggggcgttgggggacgatcagatctgagttgtggagtctgacacatgtgttcatctgtgtctccctccctgccacaggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagct

SEQ ID NO: 324263 - DNA, 729 bp, Homo sapiens
gtggctgaaccagtgagggattcagggagggatttccaggtaaggcaggtgtggagcaggcagggactagatcatgcaatgccttggaggcagtgggaggatgaggcctcattgctgggcactgggcaggaaaggaaggaagagagataggagggcaggccttgtgagtgaacctgaccctgcaagtcacatggcgaggtggcagcagctcagccccagggcaccccccggggagatgcagcttgcccaaggtccacctccactgggcagacacctctgcctggctgtctccgtttccccagaggaggagcaggagccacgcctatggtcgcatgttgctaaccatctcgaggtcaggaagatgctctgtgagacggagtgggtcagatgccaaagaaaacacaagcttgtcagcggtgatgtctccctgcaaaggcagccgccaccagcttcctgccgagatgggccggctcagcctcacttgctacagctggagatggagaggaccagatggccctgtttggcccagattccagccagattgccagggaggtgtaggcggagcagcggggtcggcgccaggagcagggatacgtgagtgaggagggcgggagccacctctttgccatctcagtagggccctgcctgtgtagggggtggcggggcaccgactgtggccttacagtggtctgtgaaccagcatatgctcagagctccctggagggagac

SEQ ID NO: 324264 - DNA, 6632 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaaggaatgaatggagaatccatgatgtaaccacagcccccttccctgggcttgttcagaggcggtctcgcctgctcattgtgagccaaggtctgtgcacctccctgttccccttggcgcccatggcccatccctgtataataagccttcctggctgtccctggagaggcctagccatgcttcctgggtccctgcacacaccttccagtcaatgaaagagcagagaggtgtggcacttctggcccaagagggtgctgggttttagtcaccttgctcttcaggttctagaaccctctgagaagtgtaattccacttccaccttgctgcacagggctctaggaaacgagccaagaggcatccctggaaccactctgctgggagctgctccgctgaaagcctgggtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324265 - DNA, 6489 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataacaaaaaaaaagaacacaacccaagaacgaacgagcaaacaacaccgcgggcgacacaactacggcgtcgccgcgaaaaccaagcggagacacgacagcgggcggccacgggcgcacacacgcgagggcctcgacaacagcacgaggagcacgtgcacacagggggagggaacaccccgccgggggcccccaaaaagggcgccccgtaaagcagcgcaaaaggcaggcgtcacacccgggtaaggcggcgccgcacac

SEQ ID NO: 324266 - DNA, 4482 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggctcccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacaaccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggtctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 324267 - DNA, 897 bp, Homo sapiens
agctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgtttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaaggaatgaatggagaatccatgatgtaaccacagcccccttccctgggcttgttcagaggcggtctcgcctgctcattgtgagccaaggtctgtgcacctccctgttccccttggcgcccatggcccatccctgtataataagccttcctggctgtccctggagaggcctagccatgcttcctgggtccctgcacacaccttccagtcaatgaaagagcagagaggtgtggcacttctggcccaagagggtgctgggttttagtcaccttgctcttcaggttctagaaccctctgagaagtgtaattccacttccaccttgctgcacagggctctaggaaacgagccaagaggcatccctggaaccactctgctgggagctgctccgctgaaagcctggggtgagcagcctgggtgaaaagagaggtggaatcttgggcttggggacatggccccgaggctccttcccacgtgcagt

SEQ ID NO: 324268 - DNA, 387 bp, Homo sapiens
gagaggttaagtggcttgctcaaggtcaagggcaatgcttacagtgtgaacatcatggagctggattcaaacaggccttccacagtcttcctcatggcctcttgcggggaacctggtgtgtcctgaccagggcccggggcccagtgccctgcctggagctgactctgcctgtgtgtctctcccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtagtacgtgcccctccctgccccagagcagcctccctccacctcttgtctttttccaa

SEQ ID NO: 324269 - DNA, 238 bp, Homo sapiens
atccaggcccaatgaaaactagatatactatgatcaaggtttcaaatatttttaggcctgatataaaaatgtagaggcctaatggaaccagaatgaaactacgtatctaccttttgataactagattctaaatataaccattggtaatcttgtatacctgcaatgaaaatgcaaatggtatgtgcagacagattactatgtaggaaaaagatggggtggtcttttacaccaatccctg

SEQ ID NO: 324270 - DNA, 991 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324271 - DNA, 575 bp, Homo sapiens
ttccggagatgaaggatcagaattgaggggtccacttaccagttccatgttgttagttgccaggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324272 - DNA, 1584 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctgaaaaaaaaaaaaaaaaaacaaaaaaaaaaaaaaaaaaaaaaaaaaaaaaacaaaaaaaagagactcgaaacacaaaaatccatataattagccgtattacaaataactaaaaaaaaaaacttcgggggggggcccgggaccaaatttgccttattgggggtgaatttcacaataattggccgccgtttaaaaacgttgagcctgggaacaccttggcgtaccaaacttaattccctggaatacaacccctttttgccggttggcgaaattcaaaaaagccccgcaccttaagccctttccaaaaattggccagccctgaagggcaaaggggaaatttggaggccgtaaatgtctggaaaaaatctcggtaaatcttgggtaaataagttcttttttaacccattggcccgaattgggaaaaaccccttttaaatcttt

SEQ ID NO: 324273 - DNA, 1888 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctgaaaaaaaaaaaaaaaaaaccccttaggccattcatttctttaactatattcaagcatttactataattaagggggcctccttttaaaccttcttccacccttttattcacaacaaaaagaacaccttctgtgattatacttcctgtggcacattaattgacccttggggaccattaattcattgatttttattcctccacaattaggcaagaagaccaaacccgagaacccccgtttcggacctctgccgggaaggggagaggtccgaggaacataggtcctcagggcttcaacaattcgagaaatacggccggaagggccccttctcggcccttatttccttcattaggccgagaattacaccagaacccttttttattaattaaagcacccttcacaatttaacagattctttccgtagggaacacaacattattagacggcacttcttccccttgaagttcttaccaccaacgattattttgggtcaccaaagagacccttattttttaaaccttccctggcttctttagtagaaatttccgagaacaagggatataccccccgggattcccgggtataagagacccaaatttcattaacacccttctttattagaaaaaaaaagtttccttaaccaatttcaccctataagaattaacataatattgaaatatgtctccaatacccctttacaatctccaggaattccccgctagagccttaaaaaaaaacaacgaaa

SEQ ID NO: 324274 - DNA, 1553 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctgaaaaaaaaaaaaaaaaaaacaaaaaaaagagactcgaaacacaaaaatccatataattagccgtattacaaataactaaaaaaaaaaacttcgggggggggcccgggaccaaatttgccttattgggggtgaatttcacaataattggccgccgtttaaaaacgttgagcctgggaacaccttggcgtaccaaacttaattccctggaatacaacccctttttgccggttggcgaaattcaaaaaagccccgcaccttaagccctttccaaaaattggccagccctgaagggcaaaggggaaatttggaggccgtaaatgtctggaaaaaatctcggtaaatcttgggtaaataagttcttttttaacccattggcccgaattgggaaaaaccccttttaaatcttt

SEQ ID NO: 324275 - DNA, 1074 bp, Homo sapiens
  misc_feature (913)..(913): n is a, c, g, or t
  misc_feature (915)..(915): n is a, c, g, or t
  misc_feature (922)..(922): n is a, c, g, or t
  misc_feature (934)..(934): n is a, c, g, or t
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaacgatactgtccagtgaaggtgccaaggtccatccttcatcaggagtncngccaggngacggattgaangggcggggctcagagaggcccccaagccggagggtggacaaaatgtggaccgtaacggaaagacggacgacactgagacgatgacagcgaaaagaacaccgggaggaagacaccgaccaggaagagaaacaggagagaag

SEQ ID NO: 324276 - DNA, 960 bp, Homo sapiens
  misc_feature (911)..(911): n is a, c, g, or t
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtggcaaacgttctgtccctgaggtgcccggtccctcctctcagagtccgcngggaaatgagtgggtccgcccccggtgccattttgctacgggcgctttc

SEQ ID NO: 324277 - DNA, 4551 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggagttgcagtgagccaagatcgcactagtgcactccagcctgggtgacagcgggagactgtcttaaaaaacaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatgcagtggcacaatcttggcttactgcagccttgatctcccaggctcaggtgatcatcccacctcggcctcccgaatagctgggactgcaggcacgcatcaccatgcctggctagtttgtatattttttagagatggggttttgcctggccgggcgcagtggctcacacctgtaatcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324278 - DNA, 4932 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagtgtactgcagtggaggtggcccatgctgggctgaggggtccctggtggggcagggacttcctgtctggggctctccctgccaagctgaagacatggaaatcctctggggtggacgggtgcagctgacgcctcgtccctactgcaaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggagttgcagtgagccaagatcgcactagtgcactccagcctgggtgacagcgggagactgtcttaaaaaacaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatgcagtggcacaatcttggcttactgcagccttgatctcccaggctcaggtgatcatcccacctcggcctcccgaatagctgggactgcaggcacgcatcaccatgcctggctagtttgtatattttttagagatggggttttgcctggccgggcgcagtggctcacacctgtaatcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324279 - DNA, 1165 bp, Homo sapiens
gacgacagtgaattggtgcctcctcgtacccgggccgcgtgctctcgtgcggatcgctgagggagatagagcgaggctgttcgacagctatacacgcaacgtcgcgtactagcatacgcggcgagactatccaggcgatgtcgcagtaaaaccgaagcgcagccacccgcgagtgagacgtcataatcgagcgcctacggagaggagaccagtggaagagcgcgagcgtacgttgcgctggtagtagcagccgtaccttggcaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324280 - DNA, 918 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaagagaggccaggagccagccctgcagccctccccacccggcatccacctgcatcccctctgggggcaggagcccacccccagcacccccatctgttaataaatatctcaactccagggtgttccacctga

SEQ ID NO: 324281 - DNA, 2023 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggatccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324282 - DNA, 1065 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324283 - DNA, 1105 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324284 - DNA, 1083 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcgatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324285 - DNA, 937 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggaaggagctgaagagaatgcaggacctggacgaggatgccaccctcacccagctcgccactgcctgggtcagcctggccacggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324286 - DNA, 249 bp, Homo sapiens
cctgcccccaccctgtgttgccatgtgtcttgctaaaggagagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccac

SEQ ID NO: 324287 - DNA, 763 bp, Homo sapiens
tcccaagtagttgggactacaggcgccaccaggcccagctgactttcttacttttttgtagaaaaaggggtcctactatgttgcccagggtggtcttgaactcctgggcttaagcgatcctgccttggcctcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactg

SEQ ID NO: 324288 - DNA, 1147 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324289 - DNA, 1561 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctgaaaaaaaaaataaagaaaaaaaattccggaagattagttttttcccttggggcgcggatttcgggcacagaggggaccggggtccgcccggggagcataggagccttcgctttggcgaggatcaaggccggccacggtcaaaagccgcggccggcaaggttcgaccatgggattgacgagttgtcgcgccggcggcatacggtcagtcggaaaacgggccccgggaactgtgtgcaaggcgccggagctcacagaggggcgagaagaattggcccccccggtggcagggctataccgccttcataattgggggggagccgcccaaggcgaaccaaggggggtgaatgggctggggcattgggtcccaccaggggttcccataggtgggggagaagcagcgcccaaacgaagaggg

SEQ ID NO: 324290 - DNA, 1130 bp, Homo sapiens
  misc_feature (1053)..(1053): n is a, c, g, or t
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccanccaccctcgtgcgattaccgcgttcgtctgtactctttttgtttgtttggtgctcttgtttgtgcgttgttgttgtt

SEQ ID NO: 324291 - DNA, 978 bp, Homo sapiens
  misc_feature (884)..(884): n is a, c, g, or t
  misc_feature (895)..(895): n is a, c, g, or t
  misc_feature (908)..(908): n is a, c, g, or t
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaacgatactgtccagtgagntgcccagtccntccttctcaggancagcagagacgcttgacggggggtaagcccagctggtggcatgtgactaacgagaggggacccaaaaacg

SEQ ID NO: 324292 - DNA, 4788 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggagttgcagtgagccaagatcgcactagtgcactccagcctgggtgacagcgggagactgtcttaaaaaacaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatgcagtggcacaatcttggcttactgcagccttgatctcccaggctcaggtgatcatcccacctcggcctcccgaatagctgggactgcaggcacgcatcaccatgcctggctagtttgtatattttttagagatggggttttgcctggccgggcgcagtggctcacacctgtaatcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324293 - DNA, 1219 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcagggtgtcgagtccgggcagggccctccatctggaagcacagcccatggaggctgcttctccagatgggcgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324294 - DNA, 4382 bp, Homo sapiens
tcctatcccacatgcttgtgaatatgatatcatttggaaaaagggtctttgccgatcagattaagagataaggagatgaagacatgctggatttagggtgggccccaaagccaaggacttgtgtccttttaagagataaaaggagggctgggtgcagtggctcatacttgtaatcccagcactttgggaggacgaggtgggcagatcacctgaggtcaggagttttcaagaccagcctggccaacgtggtgaaaccccatttctattaaaaatacagaattaacaggatgtgatgtctgtgattccagctacttgggaggctgaggcaggagaatcgcttgaacctggcaggcagaggttgcagtgagccaagatcgcactagtgcactccagcctgggtgacagcgggagactgtcttaaaaaacaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatgcagtggcacaatcttggcttactgcagccttgatctcccaggctcaggtgatcatcccacctcggcctcccgaatagctgggactgcaggcacgcatcaccatgcctggctagtttgtatattttttagagatggggttttgcctggccgggcgcagtggctcacacctgtaatcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctccagggtgtcgagtccgggcagggccctccatctggaagcacagcccatggaggctgcttctccagatgggcggtgagtgggccggggcctgaaaccccatcctgggtacctcccccagagctcctgggcctgaggaagctgagcggtgaaatgtgggagtgagggtgtcctcctctgctgggcggggctggtggtcctaagcacaggacttaggaacatcccagacacacacagtgagccctgggtgtggagcggccatgcaatgtgtctgtggcgacccgctgaccgccccctcgccctgtcctgcagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324295 - DNA, 1218 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagaaacctggggttcctgggagctgactcctgtgcagaggcagcatggtggggtgaatggtgtcccccaaaagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324296 - DNA, 994 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 324297 - DNA, 1405 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacggatagtggctacccggagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctgaaaaaaaaaataaagaaaaaaaattccggaagattagttttttcccttggggcgcggatttcgggcacagaggggaccggggtccgcccggggagcataggagccttcgctttggcgaggatcaaggccggccacggtcaaaagccgcggccggcaaggttcgaccatgggattgacgagttgtcgcgccggcggcatacggtcagtcggaaaacgggccccgggaactgtgtgcaaggcgccggagctcacagaggggcgagaagaattggcccccccggtggcagggctataccgccttcataattgggggggagccgcccaaggcgaaccaaggggggtgaatgggctggggcattgggtcccaccaggggttcccataggtgggggagaagcagcgcccaaacgaagaggg

SEQ ID NO: 324298 - DNA, 4520 bp, Homo sapiens
cttgcttccggctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggaggtgaggccccagagaatgggttggcctgaggcgcggggccatcttcaaggcctgttggttatgaacctgggtgggtgggggcatggcgtgcagcgcacagcatccctcagattaggcgcctctcccctctgctcccctgctgctttgtgcctcagtttccctcacctgcacagcagtggggggctggtgatggatcctgcttcaaaggggagggtcagagacagtgctgtgtgtgcacacgccctcatggaccacaaggcactctctgaacctagaactgaaaatatcaattaccgagcagccctctgcaacacccagagccccaagacagcccagggcgcagcgggggcagggccctcccatcagttttcttatttatttatttagagatggagtctcactctgtcaccaggctggagttgcagtgagccaagatcgcactagtgcactccagcctgggtgacagcgggagactgtcttaaaaaacaaaaaaaaaaaaggaaagaggcccacagagttaagcccatgtgacaacagactggagtgacatgtctgctagccaaggagcaccacgagtggccagcagccaccagagctgggagagaggcctgggacggccttgccctccagcctccagctggagccagccctgccgccaccttgacttcagacttacggcctccagagctgtgaggaacgaatccctgttgtccttaactgcccgggctgtggtgctttgccacagcagctccaggacattgagacaggtgacctcccagggccactgtttctcccaccctgcacttacttcaccagctggagtgaaggcagggaaccctgggtcccccaggagcagcagctgctgtgagcatcacagaaaagcagccccggagagcaggcggtccaggcaggggcttgtggtccgttcatctggctgcacagccgcgacctcattggcaggacgccccggggacaaggagcatccattagtaattggttttggttttgattttgttttcttgagatacggtcttgctctgtcgttcagcctggcatgcagtggcacaatcttggcttactgcagccttgatctcccaggctcaggtgatcatcccacctcggcctcccgaatagctgggactgcaggcacgcatcaccatgcctggctagtttgtatattttttagagatggggttttgcctggccgggcgcagtggctcacacctgtaatcccaaagcgctggggttacaggtgtgagccacagtacccggccccattggtaattgtaacaccttaggatgacaacattacagtaccaacgctacgacaactggcagtgtttatacacccttgtgtgctggagcctcaggaagctttgtaagatggtcttgggagctccttgctcctcccctgcatgatccctgtaacatggtccctcagcacggggaaacagactcagacctgaagtcacttgtctgttggacctggcactgtggcgagccctcagtggagcctggttggtatcagacatgccatgccctcagtgacacctcagacacgggccctgggcagacagcccccagatgcgcgtggatgcttacggggtcacagagccacgtttgaacccagaagaacaccagctttggtctagggtggccccctcacctgccttctctttttagctgctcaatagccatggggaatggagggtctgggtccagttagggacatggaggcatgggtgacctgtgccctcggagctgagccggtcctcagccttgcctgggctcaagcctggccctggcccgcagcacactggccatcttcagggtgcagccagcaccctgggctctcagggactgagggcagctgccctggcagtgggggtgccccagggctcccatccttctgcacggcccctcggcacccaggccgacctcctgctagaagacgtggccttgaagcccacagggttgatgggttatggtcaggagtcccagctgggcccaccagcctcctcaggaaggcgggtgaggttggtgtgagactgacggtgcctcctcatgtccccttggagcgccccaccccacatctcccggcctcgggtccttgcctggcccagcatgagaggtgcttcataggaacggagggaggacatgtcgggacagctcgatgctcggcctgctgctgctctgcacccccagggcctggctcaccctctctggacctgtctgcttccaaggaaggggaccctctgaggtcccacagaggccaccccagctgtgggtcgtgagcatctctgtcttgcagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtggtgagtggcctccctgctctggggccagcccagggaggcaagtgccccctgccacatctccaggctgcgcacggcctcgctggctgtcgtcatgggagcagagaaaggtggtgctgaaatgaggccctggcctgctgtccaggctccagctcccctgcccagtgtgggaggcactcccatctgcgcaccaggctgcagatccaaggacacggtgcccaggctgcaaccctctgttcccaagggcagagcagaaagcggctttgtctctgctcggtttctgtgtccccaccccccacgaagccttctgtgtctcggccctgggcccagtctctcaggcctccccgggccccccataccggccctcctccagggccctctggggttggggtgctgaagccctgcaaggttggtgcccccctccaccctaggatgtgactccgggccatgtccagggcactggtcacagaaagtgtgtcagttcttccccgtgagctgtccctgcagtgcctgccttccactgtgagttgcaagctgggcatttcatggtcgctgtggatctgctcccatcccacctccatccacagagggcttagaattgcagggcgagccaggcatggtgacatgcacctatgtttccagctacttgggaggcggaagcaggagtatcccttgagtctgggaggtggaggctgcagtgagccgtgatggtgccactgcactccagcctgggtggcagagccagaccctgactcacacacaaaaaagaaaataaatagggatgtcacactgtcggcgagccggccgactcggtgctggtccaggtgctggctcctgttggcaggaaaacaagaacaagaggcctcacgagtaattcgtggtcacagccacctggggctgagagggatgaggggacgagggggcctgcagagagtgggtggccccagggctctgctgcaggtgcaggtgcaggggcgggtgcgtggccctcctctagggccttgttcctgagtgttgatgcctcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctgaaaaaaaaaaaaaaaaaacaaaaaaaaaaaaaaaaaaaaaaaaaaaaaaacaaaaaaaagagactcgaaacacaaaaatccatataattagccgtattacaaataactaaaaaaaaaaacttcgggggggggcccgggaccaaatttgccttattgggggtgaatttcacaataattggccgccgtttaaaaacgttgagcctgggaacaccttggcgtaccaaacttaattccctggaatacaacccctttttgccggttggcgaaattcaaaaaagccccgcaccttaagccctttccaaaaattggccagccctgaagggcaaaggggaaatttggaggccgtaaatgtctggaaaaaatctcggtaaatcttgggtaaataagttcttttttaacccattggcccgaattgggaaaaaccccttttaaatcttt

SEQ ID NO: 324299 - DNA, 3324 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggtatttttggagttttttagc

SEQ ID NO: 324300 - DNA, 7606 bp, Homo sapiens
agagaggcccagtgatgagacgtaaagacagagaagaagtagtgaacaggagagcagtgttcttcatcccaaattccagctgtatatctacaaccagttggtcaggtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324301 - DNA, 7960 bp, Homo sapiens
agagaggcccagtgatgagacgtaaagacagagaagaagtagtgaacaggagagcagtgttcttcatcccaaattccagctgtatatctacaaccagttggtcaggtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaacaaaacaaaaaaaaaaaaaaacaaaaaaagaaaaaaaaaaacaaacaacacaaacaaaacaacagaaaaaaaaaaaaaaaaacacaaaaaaaagaaaaacaacaaatagaacgggcgcggcgcgcgcacgccgcacaatcaccctccctcccggggcggcagcggcaccccatccccgcccgccgcctgctgtatagatggagccagcccctccatcgtctccctgtacaccactcggcggagcggccgcccta

SEQ ID NO: 324302 - DNA, 9128 bp, Homo sapiens
tgttaatgaagaaaagactgagagcggtaactggatgataggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324303 - DNA, 11020 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324304 - DNA, 11113 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagagacggggtcttgctctgtcacccaggctggtctcgaactcctggcctcaagggatcctcccaccttggcatcccaaaatgctggaattacagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324305 - DNA, 11047 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattttccatttggttttctgtttgaacagtcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324306 - DNA, 9339 bp, Homo sapiens
gtggtgcactgtgtcgtggtgcactgtgtcgtggtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324307 - DNA, 10941 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcacattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324308 - DNA, 6350 bp, Homo sapiens
ctttacgtctcatcactgggcctctctcagtgtctgttttcccaaccttcatcccaaattccagctgtatatctacaaccagttggtcaggtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324309 - DNA, 5896 bp, Homo sapiens
attgtagaatcagattgaatctcctactcattgcaagaatcccttctcatctcatcaccagagaacatcattcaacttctacctgaacacttccagtaataggaattttcaaaatttcaagctaattggtttccttgttagactctaagtgctctaagtattagaagagctctttgttgtatttagccaaaatttctgtccttttaatttccacccattggtccttgttgtgtaacagcaaacacatgcttctcctactgttattaatttaatcatcaaatattcaaatgcctatttatgtgccaggagctcagctaattacacatatttttcatttaatcctcacaacaaggttcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324310 - DNA, 4611 bp, Homo sapiens
acagttgagcaaaagtaatgactttgagtaacttgagccagatggtcaccagaggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324311 - DNA, 2180 bp, Homo sapiens
agcggccgctcgcgatctagaactagtccaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324312 - DNA, 3687 bp, Homo sapiens
tgttaatgaagaaaagactgagagcggtaactggatgataggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagaggttagacataggaagaagggggtttagtatcaaggctaatgtgtatgtgacgtctaaaatgtttttaatgttgttaataaagtaatggattaggattcttc

SEQ ID NO: 324313 - DNA, 1248 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaactgaggagaaaactgtggaggaggaacacccggagggagaggaagtgtatggggaggaggcggatacaaaggaggtggtggaacaggtacaaagactggagttgctggtagtgacgggcctcgagtcctctgtgatctttcgctgtggtgtcgcccacggtttatacttctgtagcagctcctctcccctctctatttttgtttgtggtgcgagaaaccagatagccagtgtgatc

SEQ ID NO: 324314 - DNA, 573 bp, Homo sapiens
cttcatcccaaattccagctgtatatctacaaccagttggtcaggtaactttgcacctttttcagtgcactctttgatagagcatgctctgttctttttgtttgttttgtttgcttttctctctctctctctttttttttaatagcctggaggcctcttatcaaatgtcccataaattttaccttttgtttccacattaatttgacatgatgatggctcaagaagtagagtgacagctcttcttgtgctttttagtaagtgtttgtgcgatacatgtacgcatttttcttggttagctaccactatagatgtaacactagtaatgtgagcagcccacattttatttagttgtggcatctacatttgaagatggtttattagtagcctctaaactaagtaatttttcctaactcagtaatttctcctaaccctctgggcctaagatatcattggctatttaagttcagaaatcaggttaaattgagaatttgatgcatccctttactcaagtaaataaatagttacgtttatatgcataagacatggactgtggtactcagtgttctctccatg

SEQ ID NO: 324315 - DNA, 645 bp, Homo sapiens
gtttcaacccttcagagaccaagattcgaacacctgatgggaaagtgtggcaggaggctgagtttcaaaacatgagtagagaactgtatcgagatttagcacttcactttgcaggtgagaatagagctttcttatgttttgagtattttgtcatacatgctatctaatttataatatttacacataaaattgtcaccaaactaacaatattttccttctctaactgcatggcatgctgaagttgtggtggtttgaggcataaggctctcttagcctctagactcagctccagggttaaaattagcttacatggttaatgagacagaaactaggctatttttaaactgagggactttcagagttgggactgcctgatttgaaggaaacatagcagaatttagttgaagtttacttctgcttaggcctctgagatctttgaagtagtgagtaatttgtcaggcagcaggtaagatacttacatgagagcaagataccaaaagaaaaataagtattataggaagggaataagttaggaattagaaacaggaggaacccatggaagactgggagagggtaataggaaggtcatactaataatggtactacctaccgaatagtatgagcttgggcaagatgctgagtggg

SEQ ID NO: 324316 - DNA, 372 bp, Homo sapiens
gtttgtaatcagtctttatatcttcctctccctgcttctttgttcttctttctccctagggtgtatttgaatagagaggatcacctttagaacaggatgttattcttgactgcataagcacttagggaggccgaggtgggcggatcatgaggtcgggagatcaagaccatcctggctaacatggtgaaaccctgtctctactaaaaatacaaaaaaaattagccaggcgtggtggtgggcccccatagtcccaactgctcgggaggctgaggcaggagaatggtgtgaacccgggaggcggaggttacactgagccgagatctcaccactgcactccagcatggggcgacagagtgagactcggtctcaaaa

SEQ ID NO: 324317 - DNA, 675 bp, Homo sapiens
cgcccgcctcggcctcccaaagtgctgggattacaggcgtgagccaccgctcctggccggaaattgtttattttttgtagagacagggtcgcactgtgttgcccacactggtcttgaacacctggactcaagtgatcctcccactttgacctctcaaagtgcctggctctccgttggattttagatggtgttttgctattagtaatgtttgtttttaagacaaaataaattttaattggttttgtttgacaaaaaaaaaccactacattttatgatctttgtagagctgaggtgacttaatgtttaacttaggtgctacctgaatatatctttgtgacagaactcatataaatttgatgtccttttctcctaggccaaaccagggtatcagccatctggagaatctgacaaagaaaacaaagtacaggaacgtcccccaagtgcatcttccagtagtgacatgtctctctcagaacctccacagcctcttgcaaggtaaaaagggaagaatgaaagatgattaagattcttttcatgaaatttagcggagtggtctatgttcagagaattttgttgacttttgtgaacaagagggcagagaggtttatttacaaattggttcatatcttctgaaatttaggcatagtgcacatctgtacttactgtataccctag

SEQ ID NO: 324318 - DNA, 310 bp, Homo sapiens
ggcttatggtggttaaaaaaaaataataaagtgttaagccatctttgattgtagttatagtctcctagtgattacatagatttttaaatatctttaatttagctgtgttgtaagacttttctttctggaactactattatttattctttgacagttagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaa

SEQ ID NO: 324319 - DNA, 451 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttgtaatcagtctttatatcttcctctccctgcttctttgttcttctttctccctagggtgtatttgaatagagaggatcacctttagaacaggatgttattcttgactgcataagcacttagggaggccgaggtgggcggatcatgaggtcgggagatcaagaccatcctggctaacatgccgccctgcctcctactattccacacattacccagccttcggtcgcgcccccccccc

SEQ ID NO: 324320 - DNA, 7552 bp, Homo sapiens
agagaggcccagtgatgagacgtaaagacagagaagaagtagtgaacaggagagcagtgttcttcatcccaaattccagctgtatatctacaaccagttggtcaggtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324321 - DNA, 10316 bp, Homo sapiens
tgttaatgaagaaaagactgagagcggtaactggatgataggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaatctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324322 - DNA, 10883 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgaggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324323 - DNA, 9913 bp, Homo sapiens
ctgggtgatctagaggatcccgttcgacggaagcagctgtgtttctaggcttcaatacgatccagttactccaaattgctactagaaaagaccttgcttgaagagccatctcatcaacatgttacgcaggaaacacaggccaaaccagggtatcagccatctggagaatctgacaaagaaaacaaagtacaggaacgtcccccaagtgcatcttccagtagtgacatgtctctctcagaacctccacagcctcttgcaagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324324 - DNA, 9077 bp, Homo sapiens
tgttaatgaagaaaagactgagagcggtaactggatgataggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcatagcactttaagccctcaggaggaccattctaacagaaagtctgcctatgatccttcctctgtggatgttacctcccagcattcatcaggagcccagtctgctgcatcgtctcgttcatctacttcttctaaaggaaagaaaggaaaaaaggaaaagacagaatggttggattcattcactggaaatgttcagaactcacttcttgatgaggaaaaagcagaacgtggctcccatcaaggaaagaaatctgggaccagcagcaaactttctgttaaagattttgagcagactcttgatacagatagcactttggaggatctttctggacattctgtgagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggcacaacagcaacgccatgaaagagacttggccctcttgaaactaaaggctgaacaagaggctctggagagtcagagacaattagaagaaacccgaaacaaagcagctcaggtccatgcagaatcattacagcaggtggttcaatcacaacgggaagtaactgaagtcctgcaggaagcaacgtgtaaaatagcagctcagcagtcagaaactgctcgcctcaccacagacgcagcacgtcaaatctgtgagatggcagagttgactagaactcatatctcagatgctgtcgtggcttcaggagctccccttgcaatactgtatgaccaccaacggcagcaccttccagactttgtgaaacagctgaggaccagaactgaaacagataggaaaagtccatctgtttcactctctcagagtaaagaagggacccttgactcaaagcatcagaagtattctgcttcatatgatagttattctgagtcttcaggatacaagaatcatgatagaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaagactcaacgtctattgcaacagaatattctctgaaatttgatgaatccatgacagaagatgaaatagaagaacaatcatttcgatcattactaccttcagagagtcaccgcagatttaacatggaaaagagaagaggtcatcatgatgactctgatgaagaagcttctccagaaaaaactacactgtctactgccaaggaactgaacatgccattctcaggaggacaagatagcttttctaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324325 - DNA, 6824 bp, Homo sapiens
gtacgggctatcgtcgaccaggcgctcgaaatttactatggagatggttcgacagtatatgaaagaggaagaaatgagggcagctcaccagtcttcactcctgcgtctccgtgaaaaggccttgaaggagaagactaaggctgaattggcctggttagagcatcaaaaaaaacatctacgagacaaaggagaggatgataaaatgcccccgctccggaagaaacagcgtggtttgcttttaaggttgcagcaagaaaaggcagaaataaaacgtcttcaagaagccaataaggcagctcggaaggaaagacagctgattcttaaacagcaggaggagatagaaaagatccgacagaccaccataaaactacaggagaaattgaagtctgcaggggagagtaaattggactctcatagtgatgatgatacaaaggataataaggcaaccagtcctggtccaactgacttggagacccgcagtccttctcccatttcaatctccagcagtgaaactagcagcattatgcagaaactgaagaaaatgagaagccgcatggatgaaaagtttctgacaaagcgggagcaaaaattaatgcaacggcgacaacatgcagaggagctcctagagtggaagcgacgtttagatgcagaagaagcagaaattcgtcaaatggaaaaacaagctttggctgcctgggacaaagaattaataaaacccaaaactcctaagaaagaactggaggaccagagaacagaacagaaagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324326 - DNA, 6408 bp, Homo sapiens
aaaaattacatgaaagaacaaggaccaaaaagcaaagacactactaaagaaccacaaaatgcagaaacttactttaccatacatcaagacttctaaggtgtagtgattaaaataataacatttgcacagagagagacaaatagactgtgaaatagataacccagaaatagatctgtgcatctgtggaagctatgactctcctgtttgtgggagacaaaaatgcagtaagtaataatatgctaaaaacaatgtttattagtgtaattttcccattgaccaagattgtatcttttttttcttgttttcaccttctctgtctagaaatagcaagtgaagaggaatctccagtacctctgtactctcatctaaacagtgaaagctccattccagaagaattaggcagccctgctgttgaatatgtaccatccgagtctataggacaggagcagccagggagtccagatcacagtatacttactgaagaaatgatttgttcacaggaactagaatcttctacctctcctagtaaacattttccatttggttttctgtttgaacagtcacttcccaaaagctgcacatctgtgtcaaagcaggagtctagcaaaggaagtcataggactggaggacaatgtcacctgcctatcaagtcccatcagcactgttatagttggtcagatgagtcattatctatgacacagtcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagagtcatatgatgaatttattaagaaaactgaagccgagcttagccaagatttggaaacatcaccaacagccaagcctcagattaaaacgctctcctcagcttctgaaaaacccaagatcaaacccctcacaccactacacagatctgaaacggcaaagaattggaaatcactaacagagtcagaacgttccagaggatccctggagtctattgctgaacatgttgatgcttcactgtctggttctgagagatcagtatcagaaaggtctttatctgcatatgcaaagagagtaaatgaatgggacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaacaactggaaaaaatcagcttactgacagacagtttactaaaagtctttgtaaaggacacagtcaatcaactacaacaaatcaaaaaaaccagggatgagaaaatccagcttagcaatcaggagcttcttggtgatgaccaaaagaaagtaacaccccaagacctatcccaaaatgttgaggaacagtcgccaagtatttcaggttgcttcttaagttctgaattggaagatgaaaaagaagagatttcctctccagatatgtgtcccagaccggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggcggtttttgatttaacaaaagagatttttgaggaaatatttgctgaggatcccaacttaaatcaacctgtctggatgaagccatgtagaatcaactctagttatttccgacgagtgaaaaatccaaataaccttgatgaaatcaagagcttcatagcaagtgaagtactcaagttgttcagtcttaaaaaggagccaaaccacaaaacagattggcagaaaatgatgaaatttggaagaaagaaaagagaccgagtggatcatatcctggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324327 - DNA, 1790 bp, Homo sapiens
ggacgcgtgggtcgaccacgcgtcgcggacgcgtggggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaa

SEQ ID NO: 324328 - DNA, 1447 bp, Homo sapiens
ttagatattctaaagcggcgacaacatgatgtcaaactggaaaaacttaaggaacggattagaaaacagtgggaacactcagaagaaacaaatggccggggccagaagctgggtcatattgaccatccagtaatggttgttaatgttgataactcagtaacagcaaaagtcagaaaagtggcaacagcaccacctgctccagcatataaaggtttcaacccttcagagaccaagattcgaacacctgatgggaaagtgtggcaggaggctgagtttcaaaacatgagtagagaactgtatcgagatttagcacttcactttgcagatgatatttctataaaggagaaacctgctgaaaaaagtaaagagaagaaagtagtcaagccagtacgaaaagtccaaaaagtagcacagttatcaagtacagaatgcagaacaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctgggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggtaatagtagtgacatatacaaaggagagtcattcatggttaggaaatgcttatttgctatactatttaaaaattacccatcattcctagtatgctcagataatacttataataatcatggccttcatgaaatatattaaatatgaggagtaatgtgataaatgtgatggaaaataaaagctgaattaagaatttcctacag

SEQ ID NO: 324329 - DNA, 403 bp, Homo sapiens
cgcatccagctaatttttgtattttcagtagagacacggttttgccacgttggccaggctggtcttgaactgacctcaagtgatctgcccaactcggcctcccaaagtgctgggattacagatgtgaaccactcccggccgatcccctcttcttataaggacactagtccttgggtttagggctcaccctaaatctcaaggtgaactcatcttaagatccttaactgattgcatctgcaaagaccctatttccaaagaaggccatgttctgaggttccaggtggacatgaatttgggggatgtcattcaacccttatacttgctgagctagttatttccaacaggacattattaagggaaatgcttgttcaggtacctctgttacttcaggaagaataggcca

SEQ ID NO: 324330 - DNA, 297 bp, Homo sapiens
atctcattgtggttttgatttgcatttctctgatggccagtgatgatgagcattttttcatatgtcttttggctgcataaatgtcttctttcgagaagtgtctgttcatatcctttgcccacttgttgatggggttgtttgttcaacatttcaaacaacctcattgaaattgtgaccggaaatccctggcattgccaatttaatattttcaacactgaattatcttcccttcacaaaagactaaaaaagtctagatttctccgtttctagtagcagtatactgttccttcaaagtag

SEQ ID NO: 324331 - DNA, 238 bp, Homo sapiens
aagggcggggatggacagacagacaccgacacacaccccccgcgcggcaccctaagtgtccacaacttttggctgccttacttagcccagggcgcagaggctggaaaggtcgcggggagtatcgtgtgagtaaagagagagatttacaaaatagaagtagtgagaaaaagttactcaagacagctttccagcccgtgcccaggcggtaagaaaccccgaggttgaggggccaggggga

SEQ ID NO: 324332 - DNA, 2260 bp, Homo sapiens
gaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcgggccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccaccgcccggcccccgcccgcacccgctctccctgctgggctctgcccctccgcacctgctgggacttcccggagccgcgggccacccggctgccgccgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 324333 - DNA, 1143 bp, Homo sapiens
gaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcgggccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 324334 - DNA, 670 bp, Homo sapiens
ggcgggtggcggttctctgacgcccacctctttccagccccagacctcgggtcctgacgcctcgtgcccaccctacagttaaaccccaacacacacatctacaactggacataattttacattgcgacaccttcctgacgatcggccccaatccaagtaggatctccccgccctaggcagcctctgcgctcctgaatctcacctcttttgctactactgtctctctcttccaggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 324335 - DNA, 1076 bp, Homo sapiens
gaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcgggccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 324336 - DNA, 478 bp, Homo sapiens
tccgtgggcttcctacgacaccacccggatgggggctaattggggaccatccttacgcggcgcccctgggatcgtacccttacgggacccatcgtcaagaatgaaacttacattaaaaaagcggcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacgga

SEQ ID NO: 324337 - DNA, 2274 bp, Homo sapiens
  misc_feature (2219)..(2219): n is a, c, g, or t
  misc_feature (2239)..(2239): n is a, c, g, or t
  misc_feature (2247)..(2247): n is a, c, g, or t
gaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcgggccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccaccgcccggcccccgcccgcacccgctctccctgctgggctctgcccctccgcacctgctgggacttcccggagccgcgggccacccggctgccgccgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtggtgaattgaaaaanccagtgaatggggatttttntttggggncctaaaataaaaaatagggtcggcatc

SEQ ID NO: 324338 - DNA, 984 bp, Homo sapiens
gaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcgggccccctctccgtccgtgccccgcgggccaccatgtccttcccccagctgggataccaatacatccgcccgctttacccgtccgagcgcccgggggccgcgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 324339 - DNA, 504 bp, Homo sapiens
aaccctcatcacatgtcactccccagctcagggtcactcaaggcttcctgttaccttcccagtgaagcctggactcctcaattttgatgtctaagacccgcctcaactgagatccatcctgtggaggacacattttttgagaaatgatctaatttttttttctttctggtacattccccttctttcctcctcaatcaagataggaacaggtccttatgttcattgatcttgagagacgggtatgacctgaaagcagcagaactagcctacaaatgatcctgactaagcctaagcacagatgggaaatggttctcatgtgtagagcaagtaacctgctaccagaactaccaagttccaccagactagaaagagacctgcagcaagcaggacggagaagagatgggtttctgggttcacaagcagagctgctggggaagggacaagaccccaacaagggaagggtggtttgtggtggagcttggcaggcagcagcctcacaaagct

SEQ ID NO: 324340 - DNA, 444 bp, Homo sapiens
tcgcgaagtgttatcctctttctggctatttgactaatatattaactttgggtttcaataattttgaaacaaatttttttttcaattttcttttctacttctttgggttttagtagcttttctgtttttacttttaaaatatagccggtaatcattcattcaagacctttggttttttctaatgtaggcatttagtgctataaatttccccttaagtatggtctggtaatcattaagcaaattccagctacaatctttcagtcaagcaatgaacctttcccagagtaatactgcctccatctccaggaaagctaaattccagatgtgcacatttcaattcttatttctgcataagagcatgaatattccctcttcttcttagtataaaatatcaaagtggatagctaaaaggtctcctcagaattttttttttttttttttttt

SEQ ID NO: 324341 - DNA, 727 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaaggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaatatttaatcagaattcagtcctgatgcagccggcttcccacctctcttgcctcatttttttctaaataatagacttatatctt

SEQ ID NO: 324342 - DNA, 538 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324343 - DNA, 573 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324344 - DNA, 642 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324345 - DNA, 1107 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaaaaaaaaaaaaaaaaaaaaaaaaaaaaatttgtgtgcggccgcccatgggaccccagcgaaaaacctttaaaaaaaattcaaggatgggagagccagggggcccccaaatagagggaaaagaagaaacaggggccgacaacagcgagggtgtcccaagaagaagacactcgtggggaaacaacagaaaaagcagcggagagtcctcgcgaacagcagaaaaacaaacgccgcagcggtgaggagacaagcagcacgtgtacaaagacagaacacagcccaagagagagaggagataataaggagcgcgaaccacaaggggcgacactcaacaacagaggagagacaccagaggggagaggcgcggaatcgacaaaatcgcccaccccgacccggggggaaga

SEQ ID NO: 324346 - DNA, 609 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagtggtcaaccctacaagccacggtcaacccacaagccacggtcaacccacaggccacggtcaacccacaagccacggtcaacccac

SEQ ID NO: 324347 - DNA, 706 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324348 - DNA, 644 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaaggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324349 - DNA, 770 bp, Homo sapiens
  misc_feature (351)..(351): n is a, c, g, or t
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttctacctatcggtaggtgcatggtacgacgagatcatgcatcaacaggggtgtatacagctgcgcgtcgttacgcggttaccaaagcaatgatgagtcttgttgttaatggcgtcancctttctcccagtacaacgcggtaggtatagtcgcaggtaggagacatgggtgctgctggctatgataactccggaagaatttcgtgggcgtgaagaaagtagcacgtaccggcaggggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324350 - DNA, 659 bp, Homo sapiens
ctgataccaccggtaaagaaatgctgggcgatccagtccgactcgttcttatgatcgaaccgatacggactgtgcttgtggctgaaaacgtgaatgaaaagccgccccgtattgggccgcaagccacgtcttgatacgttcgagcagaacccgccagttcgacatgtgctcgaacatttcgacggaaagtggtatagggtggtatagctagctataccaccaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaa

SEQ ID NO: 324351 - DNA, 541 bp, Homo sapiens
tttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaatcaaagccgctgaatttgaaacaagctatatgtcatttccttcaaggattaattcgtcgaccggccgcgaatttagtagtagtagta

SEQ ID NO: 324352 - DNA, 423 bp, Homo sapiens
cgcttgttccttgggtcattgaattccaggccttggcctggctgagtagtttacttttattgctgctgcttatcagaggatcctgggagttaggattcttctctctcttttaaaaatgctgagagcagagtgagccactggctggagatcacgtagcccaggagccttgctttgttttaaagcaggaccaggagactcggagtttgtctaagcggttaaggacagaaaatcacgtgtatctcccagccctttctggagtctatggacctagttgccaggcatgttctgagaagcccagagccattacaaaagttcctctggcaccaggtctcacagcggccgtgtccaggatcccccaattccatgcacttgtgtttttccttgccactggctgagattctgactggtccttgcctctcgacc

SEQ ID NO: 324353 - DNA, 1219 bp, Homo sapiens
ccagacaccgttctggaccctggaaatggagggcaccctccaggtacatgcttcccagagctggtctctgaggtcccctgagccagcccctgcctctgggaagatgacccctaaatggcagcctcagtcagggggcagggttttagagaacaacaggaatagaagtatttgcctcccaggagtagataagacggtgtatgtgaaaccttgacacgattggcattcattcgtaaaatcagagcagatacctgcacacacaggcataaatgaaagatactttgaattacagaaaagttaaggtctttgcaagtgcatgtaggaatgctgccaggcacacagcgtgactccagccaccaacaaagtgtttccaagtctggagctgtgtggtccttgaaggaaatataaatgtttcacttgttatacgctgtgatttttgcgtacttagcggtttctggagtccgtgaaagtggtttgttttctctgaacgggaagtgcgtttcctccaatcacaccgacctgatttgtttgttgcttgttgggcctccccacgggaacacgagatcccacagaacacagcaggacgtgtccttgtttactgaggaatctctggggctcggcacaggtgtgcagaaagcatttattgaactgaacaaacagattttacaagccggaccttctgtggcgttggcccgggtagctacttcagcatgggtccaagcatcctttctaagccaattccattctttcactcctcctcccttgtaggatcagaaatccaaagctagcttatccttttgcagatgtttctttccatattatttcctacctccagaacaaaggctatctgtgtctcacattcggaggcttggatgtgaagccctgtctgttcatttttctctccagttttttcacaggctgggtaactacctgcctgctagcaacgatgtgttcgttctccctggattcctgattgaggtgggcagagaggactctgagacaggagcatgaggatgaggcagatcagcttctttctcatgaaatctggatgttgaggctggtagcaggaccaccgcatgtgccaatagtctttagcagctcatcaggccatagaagaagtgcctttactaacttcaagtccagcctgggaaacgtagtgagaccttgtctctccctgtctaaaaaaagaagaagaaagaaggaggaggaggaggagaaggag

SEQ ID NO: 324354 - DNA, 824 bp, Homo sapiens
cgcagatgcgcagccctcgctctcgcacgcaactcgtggccacctagcctagaggcggctgccaagcgtcctggctgagggatggcgggaccccaggcggctggagtggagaaagttgaccgcccccgtcttttctgccccgtgggtggctactgcgtgcccccaagtaacccagaggttgagggccccccagtgcgcggcggccgggggtcaggatgcgggactcccctccaccgccatgatctcgcagtgtgggggagcgctcggggacagaaatgaggcccgagatgtgtgccttctccttgctcctgaccgctgacttcgttattccaaatacgcagccgaaaccatcgctcttgcaggtgcagcttttctctgcctctcctatgtggaaagcagcgcagcgtggactccagccaaactccctcgattggattgcagctctctggctctctgtccctgtgaccttgggcagtttacctcctctatgtctcagtttcctcagctgtgcaaaggggttactgatcctgcttaatggggtgggttgttgtgaagaggaaatgagttaacataagtagagaaagagactggtgcctggcaagcactatgtgagtgtttgatgttattattgctgtttttattagagctgtgtgtaacgggacgtttaatgagccttttcctgttaccctggaattagtgagtcagggcacaaagtgttcatttcctcaagaggacacaacaaggcaccatcttggaagcagagagcgagccatcactggacaccaaacctgcaggtgccttgatcttgggacttcccagcctct

SEQ ID NO: 324355 - DNA, 718 bp, Homo sapiens
cgcagatgcgcagccctcgctctcgcacgcaactcgtggccacctagcctagaggcggctgccaagcgtcctggctgagggatggcgggaccccaggcggctggagtggagaaagttgaccgcccccgtcttttctgccccgtgggtggctactgcgtgcccccaagtaacccagaggttgagggccccccagtgcgcggcggccgggggtcaggatgcgggactcccctccaccgccatgatctcgcagtgtgggggagcgctcggggacagaaatgaggcccgagatgtgtgccttctccttgctcctgaccgctgacttcgttattccaaatacgcagccgaaaccatcgctcttgcaggtgcagcttttctctgcctctcctatgtggaaagcagcgcagcgtggactccagccaaactccctcgattggattgcagctctctggctctctgtccctgtgaccttgggcagtttacctcctctatgtctcagtttcctcagctgtgcaaaggggttactgatcctgcttaatggggtgggttgttgtgaagaggaaatgagttaacataagtagagaaagagactggtgcctggcaagcactattgttcatttcctcaagaggacacaacaaggcaccatcttggaagcagagagcgagccatcactggacaccaaacctgcaggtgccttgatcttgggacttcccagcctct

SEQ ID NO: 324356 - DNA, 214 bp, Homo sapiens
caaaaggttaggagagggcactgttctagcaatccttatttgcatcttggagtcctggagggtggggaagagctagaagttaaaggttagggaaaatccaggagggatgcatattgtatgttagatggtatcatagaattgttctcttagagttgaaaatggtattatgattatgtaaagaggatgtccttattctgacaacacaaatacttaa

SEQ ID NO: 324357 - DNA, 2392 bp, Homo sapiens
ttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtct

SEQ ID NO: 324358 - DNA, 2254 bp, Homo sapiens
ttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgtt

SEQ ID NO: 324359 - DNA, 2461 bp, Homo sapiens
ttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtctaaatcatgttgtacttggtgtttgtgaagccagttacttttcaaaaaaattaaaaaacctataatatga

SEQ ID NO: 324360 - DNA, 1278 bp, Homo sapiens
  misc_feature (1162)..(1162): n is a, c, g, or t
  misc_feature (1208)..(1208): n is a, c, g, or t
  misc_feature (1223)..(1223): n is a, c, g, or t
  misc_feature (1225)..(1225): n is a, c, g, or t
  misc_feature (1269)..(1269): n is a, c, g, or t
ttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctaggggggcttataggggntatgggaacttccaccaatttcatttggggggtaccatttcttccnttgggaattttcccntnccaaaaccaatctggttcccgggggggggcccccgggtgggatnaatttcagt

SEQ ID NO: 324361 - DNA, 2252 bp, Homo sapiens
  misc_feature (1826)..(1827): n is a, c, g, or t
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaannttaaccccttaggggttgatatgggggaaaacccctcccccccatttttttgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324362 - DNA, 2687 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaacaaaaaaggggggggcgggacgaaagtatgaaccacccggctgccgaagacaaaagaattcaaggtcgcaaaaccccgcccaagccgagccaggcggagcggccgggccaccacaaacacataaatggatcaacaaacacgcccgtgcggggtggtaaacaaaaagcgtgcccagagacaaaacaagcgcgcagggcagcatctcaccagaagaacgaccacgacgataagacatccacccaatatcaggtatcagagccgcgccccccaccacgtagaaaaaaacccaccacatggcgggcaacaataagactcccggcacaccaccac

SEQ ID NO: 324363 - DNA, 2136 bp, Homo sapiens
  misc_feature (2136)..(2136): n is a, c, g, or t
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaggttgaaaaaaataaaaagggggaaaaaacctaagcacgaatggggggttcggaggaggaattctttttccccttgtgggaaagctatttcttggtattaagtccccaattgggggtcattgggaaggcgctaaaactaccgacttaccggggggaggagggcgacaaatgggcacgcaggcatcaatcagataggggggagaacaaggaggaaacgaggagttttggaaaagggggacacatatatgaaagttgtcaaaagagatggcccattatatatgtgcgactcgtaatttattttttataatagn

SEQ ID NO: 324364 - DNA, 2214 bp, Homo sapiens
  misc_feature (16)..(16): n is a, c, g, or t
  misc_feature (20)..(20): n is a, c, g, or t
  misc_feature (22)..(22): n is a, c, g, or t
tgctaggtcgaggccngtgntnatcggccgagggcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324365 - DNA, 2301 bp, Homo sapiens
  misc_feature (16)..(16): n is a, c, g, or t
  misc_feature (20)..(20): n is a, c, g, or t
  misc_feature (22)..(22): n is a, c, g, or t
tgctaggtcgaggccngtgntnatcggccgagggcggccccggccctggaagcgccccggcggagctggcccgcggtgggctaggggcagggccggagccgcggcggcggagctgtgggtttgagaggttatttgtccatgggatgctcgtgttaaaacaaaaatcttcattgcaaagcttaagtaaaaacaagtctcgaccgagatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324366 - DNA, 2031 bp, Homo sapiens
  misc_feature (4)..(4): n is a, c, g, or t
aggnggatggagtgatgtctgacggtgtaagatgatcttagggtggccaggaaaggcctttctgaaggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324367 - DNA, 2085 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggtctacctggcccttatccccatactagttattatcgaaaccatcagcctactcattcaaccaatagccctggccgtacgcctaaccgctaacattactgcaggccacctactcatgcacctaattggaagcaccaccctagcaatatcaaccattaaccttccctctacacttatcatcttcacaattctaattctactgactatcctagaaatcgctgtcgccttagtccaggcctacgttttcacacttctagttaggtctacctgggttaggtctaccagtctacctgggttaggtctacctgg

SEQ ID NO: 324368 - DNA, 1760 bp, Homo sapiens
tagcgaacgtgaaggtcgctgtgaaaggccggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324369 - DNA, 1644 bp, Homo sapiens
cggtctaggtacgaggctgggtgtcggcttacaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324370 - DNA, 2147 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324371 - DNA, 1797 bp, Homo sapiens
  misc_feature (229)..(229): n is a, c, g, or t
ggccgggttatccagtaaaccaatcgatagcgtcggacagtgctattcgcatctctcggtggagtacttactctccctcgaatccggagtcgcactcttgtgctggcgtccccttgttagtgcttcgcacaccatggctgcagatgctcatcctagtgtatacagcgaattttgctgcaacgtgaggcatcaggaaggtatgctgcggagatcggaagtgcatactgcnccaattggccgtagctcgctcgagggcacacacattaagttcgccattgcaccagtgtctcttatcacagcctgtccgtctggaggctcttttcctcatgcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324372 - DNA, 1573 bp, Homo sapiens
cggcacgagggactagtctcgagtttcatccccttccctagagtcaggagatggagtgttgatatcttctacacactttggagtgacagggtctgtgacctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324373 - DNA, 2049 bp, Homo sapiens
tacatattcaagtagagggctgtatgacctggccacatgagtttattgataacagtagtaaaatatactttaaaatgagtttttagcaataataatagcattctaaaagttttattacttcaaagaaaagctcaattcatctttgatcaattttggttaagtcagtgtggatacttgtattagagacttaggtctgctttgggtttttgtatgctcttgctatacagcacagctcactgtttatcttaagaggaatatttgactttcttttgaaactcttcttcctgcaaccacagatagcatatgataccttcagacatagcttgaagtctgtaccccgaagtcagccatagaaaagtacttctcaaatcaaagttaatctaaaatataactatttcctgtaagagccacaatacttcaacgctggtgactgcattacattcatggcagcagcagggcccaatgcattctttttttttttgagacggagtctcgctctgtcacccaagctggagtgcagtggcgtgatctcggctcactgcaacctccgcctaccaggttcaagcgattctcctgcctcagcctcctgggtagctgggattgcaggcgcatgctaccatgccctgctaatttttttctcaagtgatccacctgcttcagcctcccaaagtgctgggattacaggtatgaggcaccacgcccggctccaatgtattctttagttgcctgttccatccatgtatctaatatctgtatttccttgatcaagtttcatttgtcttgtctttccctgtgtagttttaaatttaatgtcaagttgtcaaacaacggaaataattttgagtaactggggagctaacaagttgggtttcttgccttttagtctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324374 - DNA, 711 bp, Homo sapiens
  misc_feature (11)..(11): n is a, c, g, or t
gattggaacantttgttttcccccccccccccccccccatttatacattataaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324375 - DNA, 867 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtaagtgtataccctgctccttgtctgttggggacagagtgggagatgatgtttcagtctccctcagtttactgaacatttcctgtgtaccaggagctttcactgtttattttcttttttgttgttttattctttttaaaaatttatatttcgttattctcctagaggccctttaagaatgggtactgttgttctatccattttatgaatgaggaaatgcaagttaccaaggttaaaccattagtaagaggcaaagctgagatttaaacccagatggtatcctgcagatagcgtactggtaatcactgtggcatctcg

SEQ ID NO: 324376 - DNA, 720 bp, Homo sapiens
ctaattttttatattctttagtggagacagggttttgccatgttggccaggctggtctcgaactcctgacctcagttgatcgcctaccacggcctcccaaagtgttaggattacagccgtgagccactgcgcttgaccatttttttagtcttttctcattgactgacattagaacattgggagaacatgaggcactgaaaaataatacagtacccacaaaagataagatataaaatgaactactgaatgacaattaggaaataacttatgctttataaactaaatacatgtgatcttttccagtgagccacgtattgttagtagaattttccagtgttgtgcttggaatggtggagtgttctgggtaagttctttaaattccaggtgccttataagcatcttcagattgttgctgggttgatagctatgaactgttttcttgaaacactgagacaaatagttttcatctgctgatgtacacttagaaatataactcaggagtctgtgcatctgcagagattttattcccactcaggaaagcacacttatatgtaagcaaacgtcacagccctgaatatacacttgaattttgtttctaaaatgactcattcacaagtattagaggtagcagtttctcttgacactgtctagacattttaaaatgctaacagcaactatggggactcgggaagggcagatacggctagacaagaacaaggt

SEQ ID NO: 324377 - DNA, 2259 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324378 - DNA, 2147 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgctcaaagatctcttggggtcctctgaacagctt

SEQ ID NO: 324379 - DNA, 2140 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggaagggaacattctgccttacgtgcaccagagacaaaaatttcaattcctcagagagaagggaatacgcagagggcccttggcagagcgggctggtgaaggga

SEQ ID NO: 324380 - DNA, 2143 bp, Homo sapiens
gccgacttcccagcggccccgtgcggcccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324381 - DNA, 2217 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagactagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324382 - DNA, 2272 bp, Homo sapiens
gccgacttcccagcggccccgtgcggcccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagacggattcttgccctgtcaccaagctgtcacctgagattgccgtggtgcaatctcagcttactgcagcctctgcctcccaggtccaagtaattcttctgcctcagcgaaccggctggctggaagtacagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324383 - DNA, 2202 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324384 - DNA, 1460 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgctaaaatcaacgggaaggacagcattgagaaagagcatgtcgaagagatcagtgaacttttctatgatgccaagtcctccgccaaaatcctggctgaccagcaggataagtacatgaagtgagatgg

SEQ ID NO: 324385 - DNA, 1747 bp, Homo sapiens
ctaaattccgggcatttctttggtgtctcaatcctgcccctaatctagatttctatgttgcccagtctggtctttaactcttggcctcaagagatcctcccgcctcatcctcccaaactgttgggattacaggaatgagtcactgtgcccaccctgcactcggccttttagaaacttgagaagcagctaggaagctatctcagacagtgattggagagtgacaggtgaatggtgctaggtttccgaggctttgggattaagattttccatatttgttcttcaggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaa

SEQ ID NO: 324386 - DNA, 677 bp, Homo sapiens
gtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctctgtccctcctctgtgctggcaatgacagctcaggggccacttcccccatcaacctgccctccctatcgtctgtacatt

SEQ ID NO: 324387 - DNA, 138 bp, Homo sapiens
cctaacatagtttgcccagtgcgtatccatcttacgtgtctttgccttcatttgccagtccagttctccttgttatagctgatcctgagaccctacttcatcttgacactatatttagaatttgtacaataatctctg

SEQ ID NO: 324388 - DNA, 526 bp, Homo sapiens
ctgatgaattgtaaatatccttaattaaaaacctttactcctatgagaagaactgtaaatgacagtgctcttcacaatcctgtttcagtgcttggaatagaaaacaaatttgaccttacagttaacagagtaatgcttcattcaacagtctacttgtgagggtaatcctaaccctaacccttactgtttggtggcagatcctgacctctacttcttttcccctactgctaatatactttttctgatcaatctttttgagcctactgtacctgactacaccactttctaagttctcagactggaaaacttagttattcaatcctcaaagtcctagaagaacaaagatgccataattctgatctgagaacatcaccaaggagcttttaataatgtggaacaggccaggagaggtggctcatgcctgtaatcccagcacgttgggaggccaaggtgggcaaatcacctgaggtcaggagttcgagaccagcctggccaacgtggtgaaactccatctctactaaaaaaa

SEQ ID NO: 324389 - DNA, 218 bp, Homo sapiens
tcttgcacccggggtggcccttccccacacttggagtgacttgtgacaggcgcctctgtcccaggaggtgccaggaaactcggttgattcccacgcagagtgcttcagcctgtgcctcagacctctctgtccccagccctgcccatccaggaggagccaagaaacttggttgattcccacccacagagcgtttcagcctgtgcctcagacctcactgt

SEQ ID NO: 324390 - DNA, 630 bp, Homo sapiens
gtcacgttgcacagttttattttaaaaccataattgtgtatttaatatactgtttttctttaaatttggctttgggcctcatttccaggtgttctcccgcagaaaacatgatgtgtgtagtttttatatgcaaacgagttaaagaagagtgatctagagccaggctggtcaagacaagaattggctggaataggctgctcttcccccattccatcatgtgctgtccccacccctttggccacctgggctgactgtgtcttaatacctcaagtgcaagtatataggagtaagaaatgaacaatgcctgcctccttatactcatgcctacattgtatgacatctagtatgaaagggaaacattaaaggaaaacccttgttttgctctaaaacctgaggacggtaaacactgagagtaacctggtgcttggtttgaagtaaaacacaaatacttcccttttataatggtgatggttgtgtttgcttattagcctttttgctggttaattcttgatactgactagaaatgtgtatattgcttcttgaaatgatttaatgacttctatattggtgaacatggacgttctctaagtataatccacttatattatatttacaaatcagtaagattga

SEQ ID NO: 324391 - DNA, 592 bp, Homo sapiens
tggatctgtacagttcaaactcatgttgttcaagggccaaatgtatatctcattaactcaggggaaaaacttgatgtgagtagaaagttagaagcaaaaagagtactggcatccaattcttctttggggatcttgatgggattaaactcttttgatgacattccttcctgtcttctccattaatttgctgttccttctaatctctgcctcttcattctctgttttcaaaacacactccaatatcattattttaaacttaagtgacataaaacacgttacataaaaatatgcttctgagatataatttctaagaataaaattatatagaaattaatttaaattatatttaaaatctgtggtctagagactgacaaacttgataatactagttaactctaccacctacctgttgtatgaccctagaaaaattgttcaacttctctgacctctcttacctcatgtgtaaaatggtaattttcagaatacccttatgttatggttgttttgataattaagtgtattgattataagaaatgagaacagaacagcgtttggcacaaaataagcccctaatatatgttaacaatttgtg

SEQ ID NO: 324392 - DNA, 142 bp, Homo sapiens
accagcaatatgaccttagcctaattacttaaaattccctgttctccacatacaaaaaagggataccatttgctacttgcctcttagggctgcagtgggtattacgggagatatgtaccaagggtttttttttttttttttt

SEQ ID NO: 324393 - DNA, 545 bp, Homo sapiens
ttgcctaagccaatgtctagaagagtttttatgatggtatcttctagaatttttatggtttcaggtctaaggtttaagtctttgctccatcttgagttgaatttttttataaggtgaaagatggggatccagtttcattcttctacatgtgtcttgacagttttcccggtaccatttattgcatagggtgtcctttccccaaattatgtttttgtatgcttttttaaagatatgttggttgtgtttgactttatttctgggttctccattctgttacatacctatttttataccagtaccatgctgttttggtaactacagccttgtagtataacttgaagtcagcaaatgcgatgcctccagatttgttctttttgcttagtatgacttttgctatgtgggctctttttttttggttccatatgaattttaagattgttttttatacttctgtgaagaatgatgagggtattttgatggtaattgcatagaatttgtagattgctttgggcagtatggtcattttcacaatattgattcttccc

SEQ ID NO: 324394 - DNA, 818 bp, Homo sapiens
gtcagccgacccttttccctgggaaccccacttctctctctggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaa

SEQ ID NO: 324395 - DNA, 898 bp, Homo sapiens
  misc_feature (845)..(845): n is a, c, g, or t
gtcagccgacccttttccctgggaaccccacttctctctctggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaattactgtgtgttttttcagtttgcttngttttaaaacaaaatcccttttgaacccattgaagttggacctttctttcatt

SEQ ID NO: 324396 - DNA, 880 bp, Homo sapiens
gtcagccgacccttttccctgggaaccccacttctctctctggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccgaactcatgtagagctatctaggttagtctggaaagtttccgaccctggcttatagggcaccacacctcatgtactcctcatggcttggatctctgtattcagcctttgttcagtccaataaactttgagtagatgatctcaa

SEQ ID NO: 324397 - DNA, 369 bp, Homo sapiens
tccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaaaaaaaaaaaaaaaaaaaaattcat

SEQ ID NO: 324398 - DNA, 385 bp, Homo sapiens
atggaagccttttcttcctactacttcactttcttttctgagggtgttacgtttgtttcacatctaagaaaactaaaacaaggcttaggaagtatatcaggaaaaaactgtcatctctacttcaaagtttagtattagcttggtgcaaaggtaattgtgtttttcataattacttttaatggcaaaaaccacagtttcttttgcaccaacctaatagttaatattcctttactagaaccacctaaaaaaaaaagttaatactgtggtgaataaaatgttacctgctagagaagtaaataatacaaaggcctaaagaaaaaagattattataactacaatgtcaagatatatccccccaaaatttggggacttccagagaaatctt

SEQ ID NO: 324399 - DNA, 901 bp, Homo sapiens
attgccgcctcctgcctgttcccctcccggcacctcctcacccaatgcacccagccatggaggacagccagaagcacgtccagcccggggcaccccacagttccactccactcctccccaagtcaccccaaaaatgggttctcaagccgagcagcactggcatcacactctgtcccattcacccagttcacaggagaggaccaagggcccaggaggtcgcgtcactctgcccgaaatgccagaaacgccaactccacgcagccagaagtgggcctgacgcaggcgctcgccacaccacgtcgcccaggagggaggcagccactgtcccgggcatcagccacaggcgaccacctgggtgcagcagctgagtggcagctgaacaggttctaacacctcatcaggcagggcaggccgagggggtctactcagaactgagtcctgatcccagacggtgtgacacaacggaggcccccagagcatgcctgtgtggttccctgggcctatgaacctgtttctctcttcctttgagacagagctgcagaccccggagcactgtccttggacaactgtccactcctgggcctggccccaggatggcccagctcagaatgaactagaaggccactaggtgtgggcccctccaccccagctcgagttaagcaatctggaggcctccggcactagggccaacacagtgaggggctcttgggaatatcaaggtgcccgagggcaagagggtccccagccccttcaccaggtccctaggccaccccactggcctgagctcaaccaggagactgcccaggggccctcaaagtggcccttaggcccctccaagccagggtctcccttgagacacctcctgtgtcccaaaaccacatccccagggtggcactgcggg

SEQ ID NO: 324400 - DNA, 1632 bp, Homo sapiens
aataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacaccttaaaaaaaaaaaaaaaaaaaaaaaaaaaaaaaaaaaaaaaaaaaaaaaaaaaaaaaaaaaaaaaaaaaaaaaaaaaaaaaaggaggggggggccgggctataaaatttcctcccggggggggcaccacaataaacacgggcgaccccagtttttgttgtaaaaagaaggggggccactatagatgagacgggcgaatatataaatagcaacgcagagaagcgcggcgcgccaggttacaacaacagccgctgagtacgctggcgagaaaagcccgcgacactgcggagcgactacatgaggacgaagcaccacaccatataagggggggagggggcgacacaatatggggacaacaaccctcgcacgaccggaggaaaaaaatgaaaaggccgcgactgggggggatgacactaaataagaacacactggagcgaggctgcatcagaagcagtggtaccaacgacacgcaccgtgaccaacttatgcgcgcgcgcgcaggggtcgaagaaaaaggatgacggacccaccgagcggggggatgagtgacgtataacaaaccaaaatcttaacacgacgcggggaggatggtgaataatagagggggg

SEQ ID NO: 324401 - DNA, 993 bp, Homo sapiens
gcggccgcctactactactaaattcgcggccgctcgacgggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 324402 - DNA, 1127 bp, Homo sapiens
  misc_feature (193)..(193): n is a, c, g, or t
  misc_feature (327)..(327): n is a, c, g, or t
  misc_feature (356)..(356): n is a, c, g, or t
gtccaggccagactcctttcaactaaaggggagatctaggaatggcatctacttcgtatgactagtagactcgcatgtgccccatgaacagactggggcagtagaggtcggctgtagagctatcgtgctggggataggaattgctggtgctcctgagtcagtctgtgacttacgtgggagggtgcgccgttgnagtgtcatctgtacagccagtacaacgggccgaagcgaggcgaggacctggccgggagcggtcgcttgcggcgacacgtttgatcgcgaaggtgttcggactagattggattacagcctcgaatctgcgcatgncatagcagatgagcctagagccgatgggncccagcaaggggtctattgcaagcgaatgatgggagcgcacccaaggtctccgcacgagcacgttgcaaatcgcgacgagcattgatggaatggaccctaattgtccgttcccgtggaatgcatgaagagagggcccgagatggtacgatagatagaagagtggaaaggagtcttgggggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 324403 - DNA, 763 bp, Homo sapiens
cccgtgtggttctggggcggcagcagcgacgtaggtgacctgggcgttggtgcctgagtctctgtctgtggcgctgacactgccgatgtgcagcgacggggctgttgttctctcggacgaacagggtgtaggaggtttgggtggtcccgagcggaccggtccgctcggaccgagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 324404 - DNA, 1249 bp, Homo sapiens
ctgcagacgcgtcctgaagcttatggtttaatgtagtgatctctccctcaagctcctccactttcttttgaccttgggccttctctgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacaccttaaaaaaaaaaaaaaaaaaaaaaaaaaaaaaaaaaaaaaaaaaaaaaaaaaaaaaaaaaaaaaaaaaaaaaaaaaaaaaaaggaggggggggccgggctataaaatttcctcccggggggggcaccacaataaacacgggcgaccccagtttttgttgtaaaaagaaggggggccactatagatgagacgggcgaatatataaatagcaacgcagagaagcgcggcgcgccaggttacaacaacagccgctgagtacgctggcgagaaaagcccgcgacactgcggagcgactacatgaggacgaagcaccacaccatataagggggggagggggcgacacaatatggggacaacaaccctcgcacgaccggaggaaaaaaatgaaaaggccgcgactgggggggatgacactaaataagaacacactggagcgaggctgcatcagaagcagtggtaccaacgacacgcaccgtgaccaacttatgcgcgcgcgcgcaggggtcgaagaaaaaggatgacggacccaccgagcggggggatgagtgacgtataacaaaccaaaatcttaacacgacgcggggaggatggtgaataatagagggggg

SEQ ID NO: 324405 - DNA, 963 bp, Homo sapiens
aataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 324406 - DNA, 463 bp, Homo sapiens
aataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtggagagatcactacattaaaccataagcttcaggacgcgtctgcagaggtggagcgactgagaagagaaaaccagtctaagcgatcagcggtaccga

SEQ ID NO: 324407 - DNA, 1026 bp, Homo sapiens
aataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 324408 - DNA, 968 bp, Homo sapiens
aataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgaggcggggggggttgcttttttctggggtctttgagctccaaaaaataaacacttcctttgagggagagcacacct

SEQ ID NO: 324409 - DNA, 893 bp, Homo sapiens
  misc_feature (771)..(771): n is a, c, g, or t
aataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggtaaaaagcttaagcttttaccgctcatatattttnattttgtatcaggttgctgcttttgctcagaggacatccatgaccctaatggtcttttggtacaggataaagtgattttttgcctttgttgattaactgggcaaattcaggttagtgtattt

SEQ ID NO: 324410 - DNA, 635 bp, Homo sapiens
gattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtggtaagctcctcaactcctttggatggcctagtactaggcggtgggagggacaagaatctctccccagaaatctgacccagggtgggtctccagggagatgcaggggaggtcctgaaactgctcctgggcccccacatcaagggacctaggttcccctaccagggtttgtgggcccctaacccagtccagggcactggtgtaggggcagggtgttaaaactctccagatcccccaaatcggggacctcagtatccccctgggacttaggtgaatttataaattctttccag

SEQ ID NO: 324411 - DNA, 1881 bp, Homo sapiens
gacccacgcgtccgcggacgcgtgggcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324412 - DNA, 593 bp, Homo sapiens
  misc_feature (29)..(29): n is a, c, g, or t
taaaacgggctgtcttatttgtgcggggnacagagtttgcagatggtgatgctgtcaacatgggtcatgatctttaacaggaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaa

SEQ ID NO: 324413 - DNA, 806 bp, Homo sapiens
gacactgtagtgagaagagactgtgatccgaggacagggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgttta

SEQ ID NO: 324414 - DNA, 2090 bp, Homo sapiens
  misc_feature (371)..(371): n is a, c, g, or t
  misc_feature (377)..(378): n is a, c, g, or t
  misc_feature (387)..(387): n is a, c, g, or t
  misc_feature (415)..(415): n is a, c, g, or t
  misc_feature (421)..(421): n is a, c, g, or t
  misc_feature (432)..(432): n is a, c, g, or t
  misc_feature (439)..(439): n is a, c, g, or t
  misc_feature (448)..(448): n is a, c, g, or t
  misc_feature (460)..(460): n is a, c, g, or t
  misc_feature (467)..(467): n is a, c, g, or t
  misc_feature (470)..(470): n is a, c, g, or t
  misc_feature (473)..(473): n is a, c, g, or t
  misc_feature (475)..(475): n is a, c, g, or t
  misc_feature (488)..(488): n is a, c, g, or t
  misc_feature (499)..(499): n is a, c, g, or t
  misc_feature (509)..(510): n is a, c, g, or t
  misc_feature (518)..(520): n is a, c, g, or t
  misc_feature (541)..(541): n is a, c, g, or t
  misc_feature (544)..(545): n is a, c, g, or t
  misc_feature (559)..(559): n is a, c, g, or t
  misc_feature (563)..(563): n is a, c, g, or t
  misc_feature (581)..(581): n is a, c, g, or t
  misc_feature (590)..(590): n is a, c, g, or t
  misc_feature (603)..(604): n is a, c, g, or t
  misc_feature (606)..(606): n is a, c, g, or t
  misc_feature (610)..(610): n is a, c, g, or t
  misc_feature (613)..(613): n is a, c, g, or t
  misc_feature (627)..(628): n is a, c, g, or t
  misc_feature (633)..(633): n is a, c, g, or t
  misc_feature (635)..(635): n is a, c, g, or t
  misc_feature (638)..(639): n is a, c, g, or t
  misc_feature (641)..(644): n is a, c, g, or t
  misc_feature (647)..(647): n is a, c, g, or t
gcactctagcctgggcaacaagagtgaaactccatctcaaaaaaaaaaaaaaaaaaaaaagcgtaaaggcagttgaactaatggcagaagaagactgtcaaagcatttttttttaaccactttatgtcatggaaagcttcgaaatttcttaggcccagttaattgctctacatgaagagttcttcattaaacaaatcactaattagaaatacaggcaagagaaaagaatatataaaatttggcaagtaatagcaggttagatttgcttaaggcaggtgtcttacccattttcatggttggaacaatccttgatttctgggcctaaaataacttttgaaataattttctaagaaaattatttgcatctggcngggtgnngtggctcangcctgtaatcccagcactttgggaggcngaggcnggcggatcacntgaggtnaggagttcnagaccagcctgnccaacanggnganancccgtctctactnaaaatacaaanttagctgggnntggtggcnnntgcctgtaatcccagctactnggnnggctgaggcagganaatngcttgaacctgggaggcngaggttgcngtgagctgagatnncnccantgnactccagcctgggnnacagngnganncnnnntcnaaaaaaaaaaaaagaaaattatttgcatctgaattaatggctgaagtattaattaatgattgctgaagagaaccctgaaacttagtacttggcacatataacaaaaagttgatttatccattgcttactgaggtatccttgagaagtgatcttaagcaggagcagtgacaatgatagaattaatagtggtcatgaattactaggaaacaaagtggcattgagcagaaaagaaagaagctgttgccacaactttgggatatataaaaatggattatatcttgtgtattgtgggataaaagaggagctaaagaaaactttgcaggaggtctctcccagtggcatttaggtagcgctatgtttgaggatcaaccaaaagcggtgagttatttctgtcctgtttccccatctaagagttcttcttgcaattattggaacatcttctttaaaaaaatttttttcccttttctttttttactttttcaatttttttaaataatagatacggggtttcgccacgttcttcaactcctgggctcaagcagtctgcccactgtggcctcccaaaatgatggaattacaggcgtgagccaccgcgcctggctggaacattttctttacatacactggcttttctccccttcaaatcatcagaaaatgggataatttttagaaatcaggtttaagcactactttcagataagcatttcatagttacaacagttacctcaaaatagaagtatgaagagcaagtgagaaatctggtttcattgttacactaggcagttccctgtagaaactttgcaggggttaatagtcctgaggaagattttagttacaatgtattccaatcccatcgatctgatctgagcaaagctgacaaatgaagctggtcaaaaataaagggagattactcaggatggagtcagtcttaaacaaacttgtttctaacggcccatggtaggcatgacaacagcaggagttcaaaaaaagatgcatgcttggaaatcttacctttgagaaacatctcaaatgcagtcttagttattctaattgtagattgttgaccaagaggttgttcaatgatagaacctcaagtcatttcttaaattccaaacattttctaaatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataacta

SEQ ID NO: 324415 - DNA, 479 bp, Homo sapiens
cagtctggatagcattattaatgttgctgtgatctgtcaagatattaatacttggttcagaaaagggagaaaaattacttttcttcagtgtaaacattcaaactgtagaagtttttgtggaatatagagtgaaatacttctatatgtctaaataataactataaaaatgatgtgaatatttattattaaagaatcaaaattttaaaaaacttttttccctctccaacaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaa

SEQ ID NO: 324416 - DNA, 1836 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataacta

SEQ ID NO: 324417 - DNA, 1660 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgttta

SEQ ID NO: 324418 - DNA, 1746 bp, Homo sapiens
  misc_feature (1676)..(1676): n is a, c, g, or t
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaaaaaggaaaaaaaagnaagattggggggggggccggtaccatttggcctatggtgagtgttttaaattaatggccgtggtttttaa

SEQ ID NO: 324419 - DNA, 1838 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaaccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324420 - DNA, 1572 bp, Homo sapiens
  misc_feature (43)..(43): n is a, c, g, or t
  misc_feature (48)..(48): n is a, c, g, or t
gttgttgtggggggagcaataagaaggaaatagcttatttccntcttnatgccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324421 - DNA, 1828 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324422 - DNA, 1473 bp, Homo sapiens
agaggtcgcccgttttcattaaggagggcatacttgtcaaatatttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324423 - DNA, 1659 bp, Homo sapiens
ggcagcgctggtgctcccaggattaccgcctaattcatcataaatatgtttccactgacggcgggctgttatgtttcatatcctcccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324424 - DNA, 1480 bp, Homo sapiens
  misc_feature (35)..(35): n is a, c, g, or t
gtctgctgtgttgttggtcagtttgttaccgccgntccgccgccccgtaaattttagccggtccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324425 - DNA, 1289 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaattctatatatacaatgagtaaaatcacagattttttctttaaataaaaataagtcattttaataactaaaccagattctttgtggatactattaaagtaacatttaagcc

SEQ ID NO: 324426 - DNA, 1494 bp, Homo sapiens
  misc_feature (1410)..(1410): n is a, c, g, or t
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaaaaaaaaaaaaaaaaaaaaaaaaaaaaaaaaaaaaaaaaaaaaaaagaaaaaaaaaaaaaaaaaaaaaaaaaaaaaaaaaaaaaaaaacttcgaggggggccccggacccaaattcgccttatagtgagcggaataacaattaattggccggcgttttacaccgtcggaactgggaaaaccttggcttaccaacttaaatcgctttgagaaaatcccccttctcacattgcntattagcaaaaagccccaaccgatggcctttccaccagttgcccactctgaatgctattgggaaatggaagccgtaaattctgt

SEQ ID NO: 324427 - DNA, 2129 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgctctaaaattacatgaattttcagggagctgtgaacatttaggagcacattattcattcagcatcttttatatgcccaacatatgatattgtgttgaagatatatctgcaaagaagaaaaaaagccactgccgtcgtggagactcacaatctaggaaaagagagggacagcaaacaactcattacaatacattgggatcagtagtgtgagggagaaaaacaggtctaggttctttggaaaacatttaggagagtcaatgagactttcagaatgtgaagtgcatgggattaggtcatggaagaagaccatgtatgtcatcttgaggacttcattctgtagaccatgggccactattgaagttttgcattttggaaggagcttattagtttgttttcctgttgattatagtagtaatgcagtatcagggtagctgaactgcaataataatcccaacatctcactggcttcatgcagtaggaatatgctttcatcacagtccagtatggcaggcaacctccagactcccagggacccaaacttacactttactaaatgtaattctttcatttgaatttttaaaggtttttgtataatcatcttagtaaaacatttgataattcttcacaacatttgcaatcattgatttggccagattggtctaacatggtacccatgattttacttcatttccagtactattctgataatttcctttagagtcaattgagtagagagtacccctctcacctaagcttagtcatgtcccaggaattttggaactccaactgagatttcaggctcattattcattctagggctgaatgaataatgtgccctttgaacccttgtgccatgctggaaactgtggtcttggtgtggcatggaaaaaccagagggtgagggatgtggatgagaagatgacagagaatcagacatgcagagaggactgccaggtctcccagtgggttccagggagactcagctatccttccctcttcttgagttctgtcttagtc

SEQ ID NO: 324428 - DNA, 1824 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324429 - DNA, 1257 bp, Homo sapiens
  misc_feature (6)..(7): n is a, c, g, or t
  misc_feature (10)..(10): n is a, c, g, or t
  misc_feature (13)..(13): n is a, c, g, or t
cgaggnnccnctnaggatactcaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324430 - DNA, 1292 bp, Homo sapiens
  misc_feature (29)..(29): n is a, c, g, or t
taaaacgggctgtcttatttgtgcggggnacagagtttgcagatggtgatgctgtcaacatgggtcatgatctttaacaggaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324431 - DNA, 1936 bp, Homo sapiens
tcacctgtgatttttatgtctctctgtaagcttgccattttgaacactcgaatatattactgaagttagctttgcaaacatttcgtgcctgataaatacatctgatggatgtttataaaccagtttgaaaatttacttatttcaaggaaataaacttccaaagcaaatagtaaataataatagttaacacttactgagctcttaggaatcaaaatgttgacattatttgatttaagttattcttaaaaaccgttctatgagacagtctttctcaaccagcgtttctcatttgaaccacagaacacaaaatcatttaaatgactgtttttctaatgttctaaggatggtagtattcaagatacatatgagaaaatttaatctttacaaacaatggacagataaccttagagggcatttgagcttataagtggggaagttaaattgcttaattatataataagtatttgcagttaatttgaataggtattattacttattatagaaatataccctcgatgagcattttatttactggtagcaatattttttcctctcccattcccacttccaactttatccagccaaattctgaatttgttgaaatgcaagtgatttatacattctaaagccaattcattttaatgatacaaattattcttaaaaatccagttgctgcctgtttttgcaagtattactgtaactacactgtatctttttcttcccagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324432 - DNA, 1541 bp, Homo sapiens
ctctcgcacgaagcattcctatagacgcgatccgtatctgtgtgccgcagtagtcctagctacgtgtcaagtcgagcttaggtgcgtacgcacgtgtcgcgtatggagatacttgcgtcatggacgatagtcgctctgtgatatcgcacccatcttagcaagaatgccccgagcgtggatctcgaagccgatgactagaacgaatccagaatggagtattcttgaggtcgatcgaactgagagtctgattaaatggagtgtcgaccgtggtacgctcgagtttgcaagttacgtcgcaccgctgctgacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324433 - DNA, 1289 bp, Homo sapiens
cgaggggggtgatcagagggcgggggccagagttcgcagaggagagatcctgacaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324434 - DNA, 1124 bp, Homo sapiens
taaccccaccctttacattttgtgcagtgattatttttgaaagtcttctttcatgtaagtagcatcaaggggctcaatgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324435 - DNA, 1024 bp, Homo sapiens
gacactgtagtgagaagagactgtgatccgaggacagggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324436 - DNA, 1209 bp, Homo sapiens
  misc_feature (6)..(7): n is a, c, g, or t
  misc_feature (10)..(10): n is a, c, g, or t
  misc_feature (13)..(13): n is a, c, g, or t
cgaggnnccnctnaggatactcaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgagattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324437 - DNA, 792 bp, Homo sapiens
gacccacgcgtccgcggacgcgtggggtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324438 - DNA, 773 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaacaccgtcgaaggggtaccgagctc

SEQ ID NO: 324439 - DNA, 763 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaactcccacggatttgatagtcacgacgattattacgactggacagcggatcaatagaagtgcaactgcaatgcaatgtcagtgagttaactcga

SEQ ID NO: 324440 - DNA, 798 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaaaaagaagatagaagatggaagaagaaagaaaagaaagaagaataagaaggaagaagaaagaagagcagaaggaaagaagaagaagagaagaaaggaagaagaggaaagaacaagaggacgaagagaaaagaaaaagaaagaaggaaagaagaaagaaaaagaggaagaagaaagaataagaaagaataagaaggatgaagaagagg

SEQ ID NO: 324441 - DNA, 509 bp, Homo sapiens
cgaggggggtgatcagagggcgggggccagagttcgcagaggagagatcctgacaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgagttttaaagtcttctttcatgtaagtagcaaacagggctttaccggcacgagctcgtgcg

SEQ ID NO: 324442 - DNA, 1182 bp, Homo sapiens
gacccacgcgtccgcggacgcgtgggcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaa

SEQ ID NO: 324443 - DNA, 1878 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324444 - DNA, 2106 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaccttgaatgatgttgtttaatataaaatgcttttatttttgatggaaaggcaatcaaagcctaaagtttccaaggaacgtaaaataactgtgcttctctgagaatgcccgcctcacaagtggaacattttgagttaataatgatgatttttatgtttctaaggttgcttcctctctgaaataattcagaatccacccccatttaataaaatacctatgattcat

SEQ ID NO: 324445 - DNA, 1975 bp, Homo sapiens
  misc_feature (1891)..(1891): n is a, c, g, or t
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaaaaaaaaaaaaaaaaaaaaaaaaaaaaaaaaaaaaaaaaaaaaaagaaaaaaaaaaaaaaaaaaaaaaaaaaaaaaaaaaaaaaaaacttcgaggggggccccggacccaaattcgccttatagtgagcggaataacaattaattggccggcgttttacaccgtcggaactgggaaaaccttggcttaccaacttaaatcgctttgagaaaatcccccttctcacattgcntattagcaaaaagccccaaccgatggcctttccaccagttgcccactctgaatgctattgggaaatggaagccgtaaattctgt

SEQ ID NO: 324446 - DNA, 1609 bp, Homo sapiens
tcggtccttcaacgggtctggagtctgtgagctatctagcaaatactaatctaaggagaaggttgtgtggaacccccaatttataacgccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324447 - DNA, 1540 bp, Homo sapiens
  misc_feature (1408)..(1408): n is a, c, g, or t
  misc_feature (1439)..(1439): n is a, c, g, or t
  misc_feature (1449)..(1449): n is a, c, g, or t
  misc_feature (1484)..(1484): n is a, c, g, or t
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatcttaaatgtttttaaatttaaggcaattttttccaaagaaaggaaccgggaattaaattcttaagagagaattaatttcaataataattaatggccattacggtaaaanaaattgggacccaacaagtggaaccttaaantttggaaagnttgggtaaaagttggcccttgggttacaccttagntttgggttaaagggcaattttggaagcccccaccaattttaaaaatttttccttct

SEQ ID NO: 324448 - DNA, 1673 bp, Homo sapiens
  misc_feature (92)..(92): n is a, c, g, or t
aaaataagctcatctgagctctagccctggggatgcagcctttccaaaggctctgactctcatcctaagggcggcggtgctactgtgtggcntcatgcgatgggcagcagcaatttcagccaggaaggatgagcatatggtggaggcgtgtcctgtgggccactggacacagggccacaggcctcccatgtgtgctgggcatgttaaagggcagtggctggacagctgcatccacatagttcagcgtctgacgtcccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324449 - DNA, 1476 bp, Homo sapiens
  misc_feature (51)..(51): n is a, c, g, or t
agactgaacgtgatgaatgcactaacaccactctctatggacagctcagcngctagcaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324450 - DNA, 1830 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgagattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324451 - DNA, 1514 bp, Homo sapiens
  misc_feature (1430)..(1430): n is a, c, g, or t
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaacttcgaggggggccccggacccaaattcgccttatagtgagcggaataacaattaattggccggcgttttacaccgtcggaactgggaaaaccttggcttaccaacttaaatcgctttgagaaaatcccccttctcacattgcntattagcaaaaagccccaaccgatggcctttccaccagttgcccactctgaatgctattgggaaatggaagccgtaaattctgt

SEQ ID NO: 324452 - DNA, 1379 bp, Homo sapiens
gccggtccgtctttcattgttgaggcttcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324453 - DNA, 1369 bp, Homo sapiens
gtgctcgcttcggcagcacatatactaaaatggaacgatacagagaagattagcatggcccctgcgcaaggatgacacgcaaattcgtgaagcgttccatatttttcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcc

SEQ ID NO: 324454 - DNA, 999 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaagattcagaacctgagccgcaatgtttccaatcgcatttgaaacaattgcgtgcttaattggcttgacagcg

SEQ ID NO: 324455 - DNA, 861 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaagctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaa

SEQ ID NO: 324456 - DNA, 667 bp, Homo sapiens
agcgggcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaataacgtcttggagggggggaggtgatttatcgggtgccgtccagggtgcggaggggtccgccacctgtctggcttagcagggctatcgccgttaggctag

SEQ ID NO: 324457 - DNA, 856 bp, Homo sapiens
gaggaagtgccgcgtcttggtgggtctggagctggctgacaatgcaggagacaaggtctcgccatgttgcctaggatggtctcgaactcctgaactcaagtaatccaccttggcctcccaaagtgctgggattacaggcatgagccaccacgcccggccaaattgtatgggtctctctgtgtctccagatccctgtctgtcgctgggagctccatctctcctgccccacccatcatgccagagactgcagcctcagacccccgggaggtgctggagccacagtgcagaggtggtgcccaactcagaggaccagggaccgggcgccgccttccagctcagtgaagcaagccctccccagagctcaggcctgcggttcagtggctgccctgaactttggcaagaagatctggagggggcccgcctgggcatcttctactaaatggcctcggcttccctctttccatccaggaatcagtcctgtagcttgggtgcctccttatttgttaattagtggcttttcatgttctcctttagccaaggctccctttttccaagtgatgtctttcagggaagcagtgtttgaaatagatagcgggtaccttccctggatggagtcagggcgggggcactgtcctccactgctagacacccccagaatgcctggcgctctgcagagcacagtctgagctgctctaagaaggggtctcctttaccctaaaggcagctgggcagggacaggtgggagaatgggtgtaggaggcaggccccaggctctgcttcttggtgacagttggccagagccctgtatgctttgatttttttgtacttaaaaagaaaaaacacacacacacaacaa

SEQ ID NO: 324458 - DNA, 2095 bp, Homo sapiens
cccgccccctcgtcgcagtcactgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttataaaaaaa

SEQ ID NO: 324459 - DNA, 473 bp, Homo sapiens
gccgcaaagtccatccctacccgccttcccctccccttgcgagtggtcccgcttacccttcactgccatcatcgccctgcctttcccagtcctgctggctgcgctcagtctttaggtggtagcaggccaggtacagcggacacttgctgatgggggattccaggaggtgggatttcaaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaa

SEQ ID NO: 324460 - DNA, 2093 bp, Homo sapiens
cacaagccaccacaacacagtaggctaggtacgagcctggtgtaaatcggccgaggcccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttataaaaaaa

SEQ ID NO: 324461 - DNA, 1954 bp, Homo sapiens
  misc_feature (233)..(233): n is a, c, g, or t
  misc_feature (236)..(236): n is a, c, g, or t
  misc_feature (245)..(245): n is a, c, g, or t
  misc_feature (260)..(260): n is a, c, g, or t
  misc_feature (267)..(267): n is a, c, g, or t
  misc_feature (279)..(280): n is a, c, g, or t
  misc_feature (296)..(296): n is a, c, g, or t
aaatgcctccccgtgcacaagtccttggagcagccccttggcccaacgcaaaggcgtttccagaaagtccccactggcggaggaaggttgactgaactgcagcaccagccctgagatcttccgcaagtgtatggattattcctctgacagcagcgtcactccctctggcagcccctgggtccggaggcgtcgccaagccgaatatggggacccaggagaaaagccccggtacnagncccctgctntcccggaagatgcanactgcanatgggctacccnnaggggtgctgaggttncccaagggtcctgacaactcctgaggattttaatggcacttgataggaacagggccctgtgtataaaatacctttttatttttaaaaacaagctccactggaaaccatattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttataaaaaaa

SEQ ID NO: 324462 - DNA, 629 bp, Homo sapiens
gatctctcatggacatgaaatcctctggtgtagtcaggacccctgggcaactcagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttataaaaaaa

SEQ ID NO: 324463 - DNA, 1193 bp, Homo sapiens
tacagcggcggtacgcaccgggagtaaggatcggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagaactgcccagctcccgtggcttgagtctcagcaagtgttcagtctgaagcccttcctgctgcccactggcatagagttgaccccagaaaatccctggggttcttcggtgagctgacagagcccagtgggcaggcacccagagcaggaggagatgtagccaagaacaggatccacactatcccctgtttggacccaggctcgcatggcagcagccatcacccgatgtgaatgttctcagctcctggagcctacaggagaaaacccagattcctcaatctgctcattaagatgtgacacccactcacatcatctcctcagcccattgcctcaacagttcacgctgtcaacagttcacgctcccgtgattccagctagttccctgagcatagggggctattttgtgtctacatgcctctgcacccccacctctaggtcctctgattgactgatttctagtcagcctttaaaacttcgctgcctcttctccaccacccccaatccccaccccagagctggctgtgtttcctttcttctctgttgctgtagtactctgtacattttatgcctagcaccttccacaattgtgattctatcattgtgtctccctcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaa

SEQ ID NO: 324464 - DNA, 770 bp, Homo sapiens
cacaagccaccacaacacagtaggctaggtacgagcctggtgtaaatcggccgaggcccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaaggctgtgcgagtattgcttgacgcgttgaaggctagctcatcgatccttctaacaagaggtgcaaaacaatgcgttcaccactgggagcgtgggagagaccaacagcgagcagttgcttcttgaagggtacttcaagtgcgtgccgttggacgcttgaagtgagggagcccacgcggaagggtgaacggacggatgcacctcaccgtggcccacttgttgcccgcatagagaccaaggcctcccccacgcaagagtgctccctggtctatgactctctatcttgtctcgctaaaggctgtgggctctgggcatgccccc

SEQ ID NO: 324465 - DNA, 2097 bp, Homo sapiens
tacagcggcggtacgcaccgggagtaaggatcggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttataaaaaaa

SEQ ID NO: 324466 - DNA, 1690 bp, Homo sapiens
cccgccccctcgtcgcagtcactgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttataaaaaaa

SEQ ID NO: 324467 - DNA, 581 bp, Homo sapiens
tacagcggcggtacgcaccgggagtaaggatcggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaa

SEQ ID NO: 324468 - DNA, 1399 bp, Homo sapiens
tttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttggtaaaggttcatctcaaaacctttttagatgcttttggttgctaattttttttgtaaatatacttcggaaagcacatttaaataaaatcgcattgctttatagtattaaaaaatgaccctgcccacccaatgtttaccagtagtgtttttatccttctcattgtaaacttgagaaatttagatctgaatcagatttttagggctcctcaggttggggtgggggaatgtcataatggccgactaaccagaatcacttgttcctttcacattttgggagaaacacagtgattgtttttaaaatgtttttttttttttagctgcaataataatcaggctgtcatgcaacacctcagaccaggagtaccagcttttgtcagtgacctgatgtctgcttgtgcttaggttctgagagtgatgagtaccatcttatgcctgggtgttgtagtgtttcccatcctaaggaggaacatgtcaccccagaaatggcccagtgaaagcattttgccccctcttctgtctctctcgaaaaataaatgtttttttttcttcattcagaaaacaaagaaagccatattcccctccagatctcatgaataaatcacatttgcacaa

SEQ ID NO: 324469 - DNA, 718 bp, Homo sapiens
cagacattgcaggacaggaattttcactaatcctctttgagaattatgttgctgctcagcaggtgtttatttttaccttgaattgatttttaaaattttttgtgttggtctttaactgtcatgtttatgtagtggcacctatcactctcgagatgagagtacagacagtggactaagcatgagcagctacagtgtccctcgaaccccagatgacttcctgaacagtgtggatgagatggatacaggttggtattctttattcctcttagtaacctgacttaacagtcggatatgttatcaccaggtctcataaggtattgtaagcaaagatgattcagaagaaaaccaattaaaatcctgtaaatttgaattaaattgatcctgctttgtctctatacggtgatttgtaacttgtcttttcctagtttaaaaaaatatatatcatggattggccgggtgcagtggctcatgcctctaattccagcattttgggaggccaaagtgggtgtattgtttgagcccaggagttcaagaccagtctgggcaacatggtgaaaccccatctctataaaaaaacatacaaaaataagtcagctgtcatggtacatgcctgtagtcccagctactcaggaggctgaggtgggaggatggattgagccccggtgatcacaccactgcactccagtttgggtgacagaatgagacctcttctcaaaaa

SEQ ID NO: 324470 - DNA, 649 bp, Homo sapiens
ttattctcaaacttactctgggtgatgggtcctggacagaatagcttcacttcctttaaaggtaacttctttgtttcatctttactgcctactgtgtcgtcttttcttatgttgaagttgacagacctgctctattctcatactaatagactatttttagatttttttaaagtaatcacaataaattcagtatatcttaagtcttttggcttcctgtgaacttcttcccttgacagtttatcttagcactgaaacatcaaatatattgtatctgctttatctaatactcagaaacaaagaacctacatgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaatttgtaagtcagcctacacagccagaccatgtggcttaaagtaatttttatccgtcttattttttactcttaggcaatgcggaatatcaatcccagcacagcaaattctccaaaatgtcaggtaggctcttatctgatgttttagcactggaaa

SEQ ID NO: 324471 - DNA, 4828 bp, Homo sapiens
  misc_feature (4802)..(4803): n is a, c, g, or t
  misc_feature (4805)..(4805): n is a, c, g, or t
  misc_feature (4812)..(4812): n is a, c, g, or t
  misc_feature (4818)..(4818): n is a, c, g, or t
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaaaaaaaaaaaaaaaaaaaaaaaaaattnngnggcggcngggccnaaaaaagttt

SEQ ID NO: 324472 - DNA, 2717 bp, Homo sapiens
caaatacaataacaatgtcatttgaccagcctacgcctgccgaaaattctgcgatatattcgaccacgcatcgctaggcaatatgaacatattatggtaacatctagtaactacctagtatcttgctatggtcatagctttcaaagactctcctgtttaccaccttatactcatatgctctctctatatactacccccataatatattggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324473 - DNA, 5182 bp, Homo sapiens
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaaaaaaaaaaaaaaaaaaggggcggccgccctttttttttttttaaacggccttggctattttttcaccggaaacagctcaagttttccagaattaagagccctcggggaggggacccgcttcaagatactgaaggtgacattcaagagtcccctcctaaagggaccaattctatctaaaagttgtttacgagtaactggaatctggtgtgattagtctacttctcacaagaccatcggggcatgaggtaacgaacacggttgtagatggtccggtatgaacaagagggttaccaaaaatagtcggcatttgcttgtctaagtgaagtcattataacgacaatcagtgaggacctgaaaaaaattagtgcaaggggtcgccaaaagaatttaaagttccgaaatccaat

SEQ ID NO: 324474 - DNA, 1727 bp, Homo sapiens
agaggatctcctctctatccttatctctctatccttaatctctctatccttaatttctctattcttaatctcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324475 - DNA, 1126 bp, Homo sapiens
  misc_feature (9)..(9): n is a, c, g, or t
  misc_feature (17)..(17): n is a, c, g, or t
  misc_feature (22)..(22): n is a, c, g, or t
  misc_feature (43)..(43): n is a, c, g, or t
tcgtgcganttcggcangaggngagagagagagagagagagantctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324476 - DNA, 911 bp, Homo sapiens
gtatcaacgagagtgcccattacggccggggtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324477 - DNA, 4024 bp, Homo sapiens
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatccagatacctttggcccatggaagccataggccctattaccgattgtgtgggagtcaaggatgcctttaccatctgcttg

SEQ ID NO: 324478 - DNA, 2423 bp, Homo sapiens
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtgataa

SEQ ID NO: 324479 - DNA, 2451 bp, Homo sapiens
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatgggacgcccatcttgcgtcacatcaggtttaaagtccttgaatttagatcctcatccctctggggctgggagtatttctaccatagctaagtcctttgaggagcagagggaaccacatggatttgcatttcttacatgcaaaccttgctaaggtagcaatgctaatggtcagagttggagaaatgtcctcttgttctgtaattttcctttct

SEQ ID NO: 324480 - DNA, 958 bp, Homo sapiens
tttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtgagtgagacactgtaattacagcacatggagtaatgcttacgcattggtaaaagttgatgtggaaaatagtcattactcgtttacagaaactgggacatggtgatgtttattgtctctccagtttcatacagaagacatagtctattttaaaataacgtaagctatattattgccttgtatagttgttaacgcataagggggccgataactgaaagccagtggttctttaagatttggttctgaagcgggtatctcaaatttgtagttcatcatataattttg

SEQ ID NO: 324481 - DNA, 449 bp, Homo sapiens
cgcaatgaatctgatcctcctacaaattgctgggggctggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtgataa

SEQ ID NO: 324482 - DNA, 293 bp, Homo sapiens
cacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaacttctttgttgtttttaacaattgatatttgaaactttttttttttttggcttcttactggtcttccaatagaacaagaactggcaataaaaggtgattacagtagtaactgggaagacaagtta

SEQ ID NO: 324483 - DNA, 682 bp, Homo sapiens
ttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtgataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgacta

SEQ ID NO: 324484 - DNA, 4775 bp, Homo sapiens
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324485 - DNA, 4425 bp, Homo sapiens
tttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324486 - DNA, 4133 bp, Homo sapiens
ttattctcaaacttactctgggtgatgggtcctggacagaatagcttcacttcctttaaaggtaacttctttgtttcatctttactgcctactgtgtcgtcttttcttatgttgaagttgacagacctgctctattctcatactaatagactatttttagatttttttaaagtaatcacaataaattcagtatatcttaagtcttttggcttcctgtgaacttcttcccttgacagtttatcttagcactgaaacatcaaatatattgtatctgctttatctaatactcagaaacaaagaacctacatgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaatttgtaagtcagcctacacagccagaccatgtggcttaaagtaatttttatccgtcttattttttactcttaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324487 - DNA, 4660 bp, Homo sapiens
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaaatcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaatctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaa

SEQ ID NO: 324488 - DNA, 2476 bp, Homo sapiens
  misc_feature (2450)..(2451): n is a, c, g, or t
  misc_feature (2453)..(2453): n is a, c, g, or t
  misc_feature (2460)..(2460): n is a, c, g, or t
  misc_feature (2466)..(2466): n is a, c, g, or t
cgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtgataaaaaaaaaaaaaaaaaaaaaaaaaattnngnggcggcngggccnaaaaaagttt

SEQ ID NO: 324489 - DNA, 1017 bp, Homo sapiens
cgtgctgcaggaattcggcacgaggtcatgtttatgtagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagagaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtgataa

SEQ ID NO: 324490 - DNA, 2144 bp, Homo sapiens
cccagccctgcgtgagcactgagtgcccgccccctcctccttgcagggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324491 - DNA, 3075 bp, Homo sapiens
aattcatggcagagggcctgggattcagtatgccagattactggtgccttggcttacatttaaaagccagcgcgcagaggcgggcgcggaggcggctagaaggtgaccgcggatcccagcttcctgcagccaggtaaggctgccacccgccggcccgccgcgtgcccaggcgccgtctggctgcggccagagctggggtcaacacccacctcagcccttcttgcattctcttcatgtgacagcgcagcttccccgcgagtttcgctggccgcgagcctcaggtccggacgcagtgggggcgcctcagttgcaggccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324492 - DNA, 2894 bp, Homo sapiens
aattcatggcagagggcctgggattcagtatgccagattactggtgccttggcttacatttaaaagccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324493 - DNA, 2801 bp, Homo sapiens
aattcatggcagagggcctgggattcagtatgccagattactggtgccttggcttacatttaaaagccagcgcgcagaggcgggcgcggaggcggctagaaggtgaccgcggatcccagcttcctgcagccaggtaaggctgccacccgccggcccgccgcgtgcccaggcgccgtctggctgcggccagagctggggtcaacacccacctcagcccttcttgcattctcttcatgtgacagcgcagcttccccgcgagtttcgctggccgcgagcctcaggtccggacgcagtgggggcgcctcagttgcaggccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324494 - DNA, 2243 bp, Homo sapiens
aattcatggcagagggcctgggattcagtatgccagattactggtgccttggcttacatttaaaagccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatcctggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324495 - DNA, 2910 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgcctgtggggaagggggatcctctaagtcg

SEQ ID NO: 324496 - DNA, 1891 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324497 - DNA, 1640 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324498 - DNA, 478 bp, Homo sapiens
gccgagggcgtgtgtgcgagggctcctgtctttctggcctcacccgtgctcctggtggggagggtgtggtggccagggcatcccaggagtgtgcccgcccaggtcctgggcgcacactttaatccccaggttcgccctgtgtcattctcctgccttccagatgatgcctttatcaacccccacctggctaagatcttcgagcgggtgcggcagagcgcggacttcatgccactgaagcagatgatggtgaggagccaggggctctgcccactctctgtggcctcggcccccactgggtggaggggacagacttggggcttctcccggtggcccaggcagggcatgctcagagcccctccctggccctgcccttcagaaaactctcaacaacgacctgggccccaactggcgggacaagttggaatacttcgaggagcggcccttcgccgccgcatccattgggcaggtgcacttggcc

SEQ ID NO: 324499 - DNA, 431 bp, Homo sapiens
tggttctccagggtgtgggctggggccaggacacagctgggaagccagttgggggttgggggagtgccccaggcagggcccacccgtctccctgggctaactcccctgcctcacccatacccccacagtaccctggcgtggcccagagcatcaacagtgatgtcaacaacctcatggccgtgttgaacatgagcaacatgcttccagaaggtctgaggctaggtggttgggtcaagggcaggagtgggtggcaggcatctgtgttgggttctggggaccagagggggtcctccctgcagagcccccttcctcgctgatgccctcctccctggcccaggcctgttccccgagcacctgatcgacgtgctgaggcgggagctggccctggagtgtgactaccagcgagaggccgcctgtgcccgcaagttcag

SEQ ID NO: 324500 - DNA, 2882 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324501 - DNA, 2965 bp, Homo sapiens
acgttccttttctcgttaaggagggagtgacggggcaaatctgcgtgctgctggtggcggtgcctcccagggctgctcggcggggacgccgagggctgcacccgagctccatcccgtgttggctgcgcgccctccaaaaccccggctgtcagcgactgcgggcacctgcacgccgacgagaccggcgggcggacagcgactccgccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324502 - DNA, 3121 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcaggtgtggcccccggccgggccccttgcgtgtttgcaccagggaggcagaagggaccatgttcagcagctggtgaaggcccctccagctctgaggggcagagggctggggttgcagcctgggccgaggccatatcctgcctggggtgaaggagggccctctgcctggttggggggtgtgtgtggggggggggacggtgtggagggcctgtggctagggcgtgacctccctcccctacccagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324503 - DNA, 2828 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatggaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggatttttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324504 - DNA, 1728 bp, Homo sapiens
  misc_feature (3)..(4): n is a, c, g, or t
  misc_feature (7)..(7): n is a, c, g, or t
ggnncgngggttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagaggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgc

SEQ ID NO: 324505 - DNA, 358 bp, Homo sapiens
gaatgagaactcagcgccccgggcactgtgggaggaacccgggctggtggagggctctggtgtctcgccgccatttatccttcctctcttgccccaggtcatggaagacgcccacttggatgccatcctcatcctgggggaggccttcgcctccgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactac

SEQ ID NO: 324506 - DNA, 213 bp, Homo sapiens
gtttgttgcaaagtgcaggggacagaggagtgtggtagtaaattccaagtgtgaacttcaatatgggcaatataattacagaaaggccagtaattaggggcctttcaatatgggcaatataattacagaaaggccaggaatttgaggaaaactactatcagtgagcttatctattcccagcatctcttggacatgaaatcatctcccttcccc

SEQ ID NO: 324507 - DNA, 459 bp, Homo sapiens
ctcctggatgtagtcagggcagaaatcctaaataaatataataaattgccacctaatgccagaatggtattgggttgaaaatcatcaaaatatgacattactaagggagacacttcatactattaactcctcaacagcttctttggcctgaccatgggtctataaatactgggtagttaagagaaggtaggaaggaaaagaagaaggagaatctggcattcgtagccaccaataatgaaactttctagtcctgcctcccccaacccttgacacacagaacagcattacatgaaacaggaagctgaatcataattctggttaaataataagaatttatagtttatttcataagctaacatagtgagaagaaggggaaaaaaaacatcctggaagcctcaatggaaaacctatttttgaggggagaaaaaaaactaaacgtttcacggtagcagtaaagca

SEQ ID NO: 324508 - DNA, 1826 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324509 - DNA, 508 bp, Homo sapiens
ctagttttagaagtttcaatacgcaataatgtttcttttatacagaaactaataatacaattacctggaaagcagtagcaattaatttttctttttaaacttcttaatcagaaactttaagcagcttgtcagctttgattttcagattgctaacaagcattctgccctccatttttttttttttaagattctctgctattgaaacttctaaaactaggcctagttttagaagtttcattggcagtcgaggggaatcatttttcctctggaatttaatttttctaagggtctctcttcagttaatgccgccttcctgaggctgtctggctccagacctgtctggttctggtctcagggagcgtagctattgcggtaatccaggtgagaggtgattggggtggcagtagtagagatggacagattcagtaaatattttggagttatgtcagccaagctccagtcaggaagtctgaaaccatgctagttatttctaacaaagggtgtttag

SEQ ID NO: 324510 - DNA, 1708 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctctaaaaaaccacacacacaaacacacacaaaaacaaat

SEQ ID NO: 324511 - DNA, 1961 bp, Homo sapiens
agctctgattaacagaaggaccagaacctccggagacaggcccagcctgctgagcctaagcgccagggaaccggcgggacagcatcagttccgaggtccgcagcctgggacccgcaccaccaccacgaagttctcgcagagcaaaaacgccgggccgtctcaggggcaggtcccagcaaacgagggagtccagctggttggggggtggtgcggaagcgggcacgacgacagatggactggagtcagctccatcggatctccaggagaccgggcacaggaggccacactgctccccgagcccggagcaaaagcactctgccctagaccctcagggcggggctcctccggcccctgccccaggcccgccgacaaggagagacgaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324512 - DNA, 1493 bp, Homo sapiens
tgcttcctttattcccccaagaaacttaggtgggatcctatctgcaagataagggtgaaagtggagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324513 - DNA, 1888 bp, Homo sapiens
acaggctctcactctgttgcccgggctggagtgcagcagcatgaacactggacactgctcactgcagcctcgaactcctgggtttaagcagacctcctgcgtcagcctcccgagtagctgggaccacaggcgcatggcatcacacccagctaattttttttctttttttttttttgtagatgggatcttgccatattgtccagtctaggctcaaactcctgggctcaagtgatcctcctgcctccccttcccaaagtgttgggattataggcatgagccactgcccctggccagagtttatattatttatgtaatggcagataatttgaatagtataatgtctaacccaatgccttaagcacagtaatgtttagtaaatatatcttgaattgaactggcagagccatgactagaattcagtctcctgtctctttagccagatgttccaataaaccttgttttataaaatggttagagcataaaatattaaaaactaaaaaatacttgtttttaaaaatcattttaacaataatctaaaggaaaaactttttttctaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324514 - DNA, 1096 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccttcttacaaagggaaaaagcaagaacatacgatcacgcactggtgactcgttaccccaggacacgtcggggagtgcactgaaacattccgtgtctgagataaaactacacaccttgtttattttcattcatgataag

SEQ ID NO: 324515 - DNA, 1119 bp, Homo sapiens
  misc_feature (43)..(43): n is a, c, g, or t
  misc_feature (85)..(85): n is a, c, g, or t
  misc_feature (93)..(94): n is a, c, g, or t
  misc_feature (111)..(111): n is a, c, g, or t
  misc_feature (143)..(143): n is a, c, g, or t
  misc_feature (152)..(152): n is a, c, g, or t
  misc_feature (159)..(160): n is a, c, g, or t
  misc_feature (168)..(168): n is a, c, g, or t
  misc_feature (172)..(172): n is a, c, g, or t
  misc_feature (199)..(199): n is a, c, g, or t
  misc_feature (210)..(210): n is a, c, g, or t
  misc_feature (215)..(215): n is a, c, g, or t
  misc_feature (232)..(232): n is a, c, g, or t
  misc_feature (234)..(235): n is a, c, g, or t
  misc_feature (246)..(246): n is a, c, g, or t
  misc_feature (259)..(259): n is a, c, g, or t
  misc_feature (278)..(278): n is a, c, g, or t
  misc_feature (283)..(283): n is a, c, g, or t
  misc_feature (292)..(292): n is a, c, g, or t
  misc_feature (310)..(310): n is a, c, g, or t
  misc_feature (313)..(313): n is a, c, g, or t
  misc_feature (333)..(333): n is a, c, g, or t
  misc_feature (349)..(349): n is a, c, g, or t
  misc_feature (360)..(360): n is a, c, g, or t
  misc_feature (362)..(362): n is a, c, g, or t
  misc_feature (393)..(393): n is a, c, g, or t
  misc_feature (439)..(439): n is a, c, g, or t
  misc_feature (442)..(442): n is a, c, g, or t
  misc_feature (457)..(457): n is a, c, g, or t
  misc_feature (477)..(477): n is a, c, g, or t
  misc_feature (542)..(542): n is a, c, g, or t
  misc_feature (569)..(569): n is a, c, g, or t
  misc_feature (581)..(581): n is a, c, g, or t
  misc_feature (608)..(608): n is a, c, g, or t
agcccttagcggggtggcttcttcaacctgcttgggtttaaancatggatagaaatttcttaaatggcatgcaagcaaagcattncagcagcnnagcattaattggaaaangtaaaaaaatggccctatggaatgattggcanggaaaaaangaaatgnncgcaaaanggcncattttggagcagctgttgggattttngatgatggcantgctncttagaaatttagcagncnnggttgcttaanggcgcgcgcgctngctgagcttggtggcagcntagcnagcgcatgngcgcgcatttgcgcgcgnagnattttgagcagctgcttganttggcatgggaaattnggtgcgcgcgngngatgtttttgaaatgatggctttttttgtgnggcacatgtgtaaatggcgctgcgcgcagcggggcatgatgatttngantttggcatggcgctngggcatgatgtaagcatttngagcagttgagtgcttgtggcgcatttgctatgagcatgcgcgcttgtgctagcaatgatgtgcnggatgcgcagtgccgctgcgcatgctngctgcttttgcncctgctagctgcatgaatttgcaatgnagctgcagcatgcattttctaaaatgctgctgcgcttgaagtgcaatgaaatgcattcagctgcgcttgcatgcgcaattgcgcagcgctgctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324516 - DNA, 682 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggtaagagaggaaagaagagaaatgctactgaaagagcaggatggattcacggttgtcttcaagaagttcttattttataatagcaaatgttgactttcagcgtcaatttacttcacttgccattgtttgttttctgactagttaagggggagaaatcatagccttccaaattacaggatcttcccccaatccaaccctgtcaccatttacttcatgttactgctttgctcactgtctgccaggaattcactgttctttttctttttcttttctttttttttaacttatgtttttcctagctttgaagatgcttcataacctccccttagcctgcaaccc

SEQ ID NO: 324517 - DNA, 186 bp, Homo sapiens
ctcgttctttcagaaccaagttccctcatgaatggaagcaggaaggaaataaagggggttcattttaaagaaattaattcttgttaaaatatagcaattagcatatccctaatactcaatattccctctcctcttccttgcagcattttaaagctctcgctgaaggcaagaaagcattcactcctt

SEQ ID NO: 324518 - DNA, 348 bp, Homo sapiens
agaggcccagaggctgggaacatatttgatcaacctgaggtcctgtggatcctggcaactactggctgagattgtagacataaagattgtaatttctctagtattacttagctacctcctccaaaccccaggccctgggtaactttggtatgcccagtctaggttctcctgaagccttcctgatgtgccagattgaagacctctccttcatcctagaatatgctgatccagaggttgctgatgttatcagttcacgtttcttgttcatatttacctttatacttttaggcccatgcccgacattgacacgctgatgcaggaatggtccccggagtttgaagagctttt

SEQ ID NO: 324519 - DNA, 360 bp, Homo sapiens
tacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctctattatattgtcagattattctgctatttaatatgaaagagaaaaggctgactgagcataacgcagagacacaggaactttgcttagtaatgggcattaaatgaagagtagttaaagcaaacaaattttgtgaaataaaatgaaaccccaatcctccaagattggcagtcgaggggaatcatttttcctctggaatt

SEQ ID NO: 324520 - DNA, 418 bp, Homo sapiens
aattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatc

SEQ ID NO: 324521 - DNA, 1673 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324522 - DNA, 913 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatttgaaagtaaaagcctgaaaatgccaagcccctgcgatgggcccta

SEQ ID NO: 324523 - DNA, 1808 bp, Homo sapiens
agctctgattaacagaaggaccagaacctccggagacaggcccagcctgctgagcctaagcgccagggaaccggcgggacagcatcagttccgaggtccgcagcctgggacccgcaccaccaccacgaagttctcgcagagcaaaaacgccgggccgtctcaggggcaggtcccagcaaacgagggagtccagctggttggggggtggtgcggaagcgggcacgacgacagatggactggagtcagctccatcggatctccaggagaccgggcacaggaggccacactgctccccgagcccggagcaaaagcactctgccctagaccctcagggcggggctcctccggcccctgccccaggcccgccgacaaggagagacgaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctcta

SEQ ID NO: 324524 - DNA, 1141 bp, Homo sapiens
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatcctgtcttcggtcgttt

SEQ ID NO: 324525 - DNA, 363 bp, Homo sapiens
ctcgggtgctattgctgtcccaagagtcctgccaaaactcacaccacactgtcttttatgtaagggcaaacccctaaacaccatagcaactcagaacagactcaaacaaggagaacctgtcatgaggttccagtgtgctggactatgaaagactagtcacagggttgtctatactaaaaatctccttactgatctctgggttcctgtttccatggtgattttacacacactacagaccctgtttcgtacagcaagacatagactaacaaagcagaaccattttaataatttcaggttcattaaagaggccttagactcttttactaagcatatcttcatgcacacactgtatatttggggatg

SEQ ID NO: 324526 - DNA, 1781 bp, Homo sapiens
ccaggaaggaggggcttagcttcggccgccattctgaggcagccacctccacccccacccccaccgcaacagccagccaaggcgctaggagtctccagctgccggcctcagctggtgcactagtaccgcagtcccagcaccttgcccggaatcccgtcaccccgcaggatggggcagggacaggtcatcttcaagccaagggaagagcaggttcactgccacccgcgatccccttttcttcctggatcttacagccaggctagggggcgtcgaacccaatggggccttagatcattccttgtccggaacagaatctctgcggaaccgccagacagacacacagctgctgctgcggatactggcttcttggggccaagacctcaacatgcaggacctcacatttccagcgatgcacacgttttttgagaacatcccgacctttcctcctccccaggaagatgctgcagacgtgcccgccatcccaggtctcgaagagctcttaaggcaaacctccggcacccgggccacacccaccggccggcccactctcctcgcgcatcccccaacctgccggcctaaggggaatggttcccttccctggccacatggtagacccttctcccatccagccctttctcccacaccatcccgaaagaactattcatccatccttccagaacagtaccccggcaaacggcatctctcacctgggtatcgaacccgttttccaccgagccgctcttccgcagcgggagcccctcccccgctggctcctgcagcccctgcagcacctgcgatttcagggggatctggctaggataggtggtcttgctcacctccaccttgcttcccaacttcaggtagcagggctgggggcccgcccgggccgggggcacgtgcaggatgggcgcggcgctgtgcacgggtttgggcagtcccgacttcattttggaggcgaccaggatggccggcatcttctcccggggcttgggctttcccagcacgtccctggcagcggcggcgggggcgaccgctaaaggcagcgcgggtagcagagcaggcgccgggccttagcccacgaggcgcccaccaccagcggctaaaaaaaaaatccccaggtcggggaactcgaagcaatcgggcgagcgcgcctttggggtgccgggatgggaatgggggactggccacggcgctcagcgggtcccacctggacggatgctgccgccgggtctcacacctctcctgggtggcctttcaagagctctgggcgctcaggggctgccgcctcttgcaaatttcctcctgggaaacagaggcttggacgcccatattaacttgtcactgcatctccgaagtgaggaggcccctttggaagagacagaggcggcggcgacccacgagtcccgttccggaggctacgggtctgagccggcgagagaaagagcgagcagccaaggaaggaaaggagacagcagcgaaggaaggagagaagaagggcgcaagggtcccaagacgtctccaccgagaggcagctgccaccctgctcgcgagcaccgcagtgtcacccgcgacgcagcagaggtgcggcaagagcccccgaaaggtctctcttggggtgacagtcaccgctgcccagaaggcccccggactgagagcaccttagcgcctgcgggtctgcacatgctccgtgagctagatagaggcaaggctgtggccgtgggggcgggcgccgggacgcgcggctggcgggccgggcagggctgcgctcgggagcggccgcc

SEQ ID NO: 324527 - DNA, 331 bp, Homo sapiens
cccacgagtcccgttccggaggctacgggtctgagccggcgagagaaagagcgagcagccaaggaaggaaaggagacagcagcgaaggaaggagagaagaagggcgcaagggtcccaagacgtctccaccgagaggcagctgccaccctgctcgcgagcaccgcagtgtcacccgcgacgcagcagaggtgcggcaagagcccccgaaaggtctctcttggggtgacagtcaccgctgcccagaaggcccccggactgagagcaccttagcgcctgcgggtctgcacatgctccgtgagctagatagaggcaaggctgtggccgtgggggc

SEQ ID NO: 324528 - DNA, 357 bp, Homo sapiens
ggctctgtctggaaaggtaggagtcaccaattctcttcaagccatctcccatccccacgccccgtcactcgggctaccaacaccaggatctaccacccaggaaggaggggcttagcttcggccgccattctgaggcagccacctccacccccacccccaccgcaacagccagccaaggcgctaggagtctccagctgccggcctcagctggtgcactagtaccgcagtcccagcaccttgcccggaatcccgtcaccccgcaggatggggcagggacaggtcatcttcaagccaagggaagagcaggttcactgccacccgcgatccccttttcttcctggatcttacagccaggct

SEQ ID NO: 324529 - DNA, 992 bp, Homo sapiens
gatgagaacagagccctggagaaaagagccttgcaagggccctgcaggagagagtccctgggaaaggaaaggaaggggcagaagagtggggtgatgctcttattggtaagtgggagtaaggggcaagcagcaggatcagctatggagacattagggatttgtaattaaataacaatttatgtcttagttatgaagtgcataacaatttatattgacctgagagtgcatataggcgttttagaaaatgctttcattagtcagttcccaggcttaactttagagcagtaacttacctctgccattgttcattacatttcttaagccttgccctctgtgcccagtacagtgctgggagcatcaggatgagtggatggggccttccccgtaagactcatactgcgcgtatgcacaagcacacacctggctctgcaagagctcagctctctcctgcttcctcacaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324530 - DNA, 5793 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324531 - DNA, 5940 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324532 - DNA, 1254 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggtgagtgtggcggccgcagtcggtcgctcgcagaaagcggggcgggtcctggcccgaactcggtcgggcccgagggcctctgcttcccgccaggtggggagggaagcatccagtctctgcaggctggggcgggaggggcgcggtgcatccctgggtcccaggggaccgcgtctgagtctgtccggcgactcctcccggggttgcagctccgcagggttccgctcgagcgtgttgccggctccccttcccttgtagactcccccagctcaccctcaacgttgcgggggctgggagcagagtgcggctgcctcccctgccgctagcttcggaagagtggcctcactgaagtgcctctcatcattactgaacgaaagtggtccctcccctctgccctcattcgagtaaaagagacattcggaaatcgagtgcgtactggctatttcccgcgttctcctcctcctctccttttgcccgctccagagaatgcctgtcatct

SEQ ID NO: 324533 - DNA, 527 bp, Homo sapiens
acagaatggagtcctgttctacatcacaggtcttctcatttcagagcacagtaactttgcctaattctcaggaaatctccatgagttacatcatttctgccttctctctgaaactagaggagttcctcctaaaatgtaagttgtagactgtagtcattaacccgacatcataaagcactgaaacccatcctgccattcagaagattcttctaaaacgccccttacaccacttcttgtgactttttttccgtttttttgctgaaccactgttgagtacactgttaagtaatactggtttttttcttgtatgtatttagggagccattgtgaaatgagagaaaattcaaacctcaaattgagtttcctccttgtgtttagaaataaacacgtcgagggaaagaggataacttggagcatcgtggtgtagagcatgagcttccaggggaagttggaaatggatcatttttaatgtttttacaaattatgtttaaaaaggatgtgtttcagtacttaataatgtatttgta

SEQ ID NO: 324534 - DNA, 5839 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgtccgtcagatctcccatgctgtttcttcctccttaaattgaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324535 - DNA, 5930 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgtccgtcagatctcccatgctgtttcttcctccttaaattgaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagaagcacagtaactttgcctaattctcaggaaatctccatgagttacatcatttctgccttctctctgaaactagaggagttcctcctaaaatgaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324536 - DNA, 1866 bp, Homo sapiens
ttcaagtccgttccctcttctcacatgtgttcctgaagcttttcttcttgtcttagcactcggagcatgccttccgacgcgcggagccatggcagccctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324537 - DNA, 5878 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgtccgtcagatctcccatgctgtttcttcctccttaaattgaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaaaaaaaaaaagtcgacgcggccgcgaatttagtagtagta

SEQ ID NO: 324538 - DNA, 716 bp, Homo sapiens
aaatgaggacagcacgatcggaggaggtcatctagaagtacatggactttttcactctgtggaattgcacccgtacttatggttgagcaaccgtccaggaggagaaaacaacaggtggttgatgtataaaaatattgaagataaaagcatctattccaagagcagattataactagactgtatcattttaaatgcatttttttctcttctatttaagaatgccaaataaaatgacataatttcttctatatttggtaattcctttaccaagtggctgaattgtttgtagtggttaatgtctgtgtgatgatgaacgaaatcttcctttaaaatgtggtaagtattgtatgatttgcttcattttgcattaatcatggtttggactcttcagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgaggtaggttcaaaataagaggaaacacggtacaatttagtaattgcttgataacttacagaaagtttttggaaccttttacagtaaatctgatattgtaatcatagcttaatcaagaatatcatcttatatcactgctgtatatcagagatgttagtttactttt

SEQ ID NO: 324539 - DNA, 3374 bp, Homo sapiens
gaatctagaaactattgtaggttttttagaggcaaggttccctctgagttttttgaagatttaagtaggaagatataaaacacggatcgtctggttggagtttatggctgctggaacctgtgtgtgttgttttgcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324540 - DNA, 2989 bp, Homo sapiens
ttgtcatttcatcccgggacgcgtttacttgatgcatctggtccctggcgaccagttacaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324541 - DNA, 1761 bp, Homo sapiens
cccgtctgacttggagctctcacctagggacaggtcaggacgtcggggcaggcagatgtgaaggctgctgccaaatccatcagcagtgccatgataccgggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatgaagcctagtagaatatggacttggaaaattctcttaatcactactgtatgtaatatttacataaagactgtgctgagaagcagtataagcctttttaaccttccaagactgaagactgcacaggtgacaagcgtcacttctcctgctgctcctgtttgtctgatgtggcaaaaggccctctggagggctggtggccacgaggttaaagaagctgcatgttaagtgccattactactgtacacggaccatcgcctctgtctcctccgtgtctcgcgcgactgagaaccgtgacatcagcgtagtgttttgacctttctaggttcaaaagaagttgtagtgttatcaggcatcccataccttgtttttaatctcctgtttgttgagtgcactgactgtgaaacctttaccttttttgttgttgttggcaagctgcaggtttgtaatgcaaaaggctgattactgaaatttaagaaaaaggttcttttttcaataaatggtttattttaggaaa

SEQ ID NO: 324542 - DNA, 5221 bp, Homo sapiens
ttcgagcctgtggaaggctgcgctgtcaagagaccggagttgcgagcgtctgggtgacgtccgtcctcctggaaggtgggatccgggtggcaggtccctgggcggcgactccggccgggctcatagcgtcgcgcccgccccgctcatcggccctacccagcgtccctcccagaccgacgaccgcctgggaagcctcgagctcccagcccgctgcacagcccggctccgctccacagtcccccactgccaccggccggggcgacaccgggcgagctggcgagacccggctccaggaccgaatcgcgccgacacttgacggcgctccccgcccctccctgccgccgtctccgcccccgtccggtcgcattccggcgcccgccgccgccgccgccaccgccgccgatctgggaggcttgtccctcgccgcccaccgtagccccggcgctcggccggtcgccgtttccaagatggccgcggcgcgcacggctcctgcggcggggtagaggcggaggcggagtcgagtcactcccgcacttcggggctccggtgccccgcgccaggctgcagcttactgcccgccgcggccatgcggggctccgtgcacggatgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaaggtgtccgtcagatctcccatgctgtttcttcctccttaaattgaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagaagcacagtaactttgcctaattctcaggaaatctccatgagttacatcatttctgccttctctctgaaactagaggagttcctcctaaaatgtaagttgtagactgtagtcattaacccgacatcataaagcactgaaacccatcctgccattcagaagattcttctaaaacgccccttacaccacttcttgtgactttttttccgtttttttgctgaaccactgttgagtacactgttaagtaatactggtttttttcttgtatgtatttagggagccattgtgaaatgagagaaaattcaaacctcaaattgagtttcctccttgtgtttagaaataaacacgtcgagggaaagaggataacttggagcatcgtggtgtagagcatgagcttccaggggaagttggaaatggatcatttttaatgtttttacaaattatgtttaaaaaggatgtgtttcagtacttaataatgtatttgta

SEQ ID NO: 324543 - DNA, 898 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggag

SEQ ID NO: 324544 - DNA, 516 bp, Homo sapiens
aggtcgtctagaggatccctcataggttcgcaggctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgcgaacctattcataggttcgcaggcatggcgggttgtgccatactcatgaccatcgcgctagcactgctggagcagctaccctggatgtcctatctgagcatcgtggccatcttgggctttgtggccttctttgaagtgggtcctggccccatcccatggttcatcgtggctgaactcttcagccagggtccacgtccagctgccattgccgttgcaggcttctccaactg

SEQ ID NO: 324545 - DNA, 196 bp, Homo sapiens
tgaggaatgtatctatatatactagtggaatattgtggtttagatattttaacttaagggacaacccggctttgccaagtatagaagcagttcctcatccttggatgagaaactgtttctccaggcgactttgaacccattttttggcagtgttcatattattaaactagtcaaaaatgctaaaataatttgggag

SEQ ID NO: 324546 - DNA, 2153 bp, Homo sapiens
  misc_feature (2016)..(2016): n is a, c, g, or t
  misc_feature (2019)..(2019): n is a, c, g, or t
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaacaancancaccacatacaaaacaaaaactttttgggcgggctggcccctggaaaagtttttaacacttggtgggggcgcggcccgagttgcgaacatgctagcgtccaggaacgtgcgaaacggcgggttttccaaaaaag

SEQ ID NO: 324547 - DNA, 2070 bp, Homo sapiens
  misc_feature (2041)..(2041): n is a, c, g, or t
  misc_feature (2043)..(2043): n is a, c, g, or t
  misc_feature (2045)..(2045): n is a, c, g, or t
  misc_feature (2053)..(2054): n is a, c, g, or t
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaaaagcaacacacaaaaaaaaactntntnggggcgcnntgggcccctggaaaaa

SEQ ID NO: 324548 - DNA, 2074 bp, Homo sapiens
  misc_feature (2021)..(2021): n is a, c, g, or t
  misc_feature (2023)..(2023): n is a, c, g, or t
  misc_feature (2029)..(2029): n is a, c, g, or t
  misc_feature (2045)..(2045): n is a, c, g, or t
  misc_feature (2047)..(2047): n is a, c, g, or t
  misc_feature (2049)..(2049): n is a, c, g, or t
  misc_feature (2057)..(2058): n is a, c, g, or t
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaaaananaaaaanaaaaaaaaaaaaactntntnggggcgcnntgggcccctggaaaaa

SEQ ID NO: 324549 - DNA, 1836 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatccggcttctgggaaccgctttattgtctgtttaacctggccccgggaattgggggtggttcccgaaggatttgg

SEQ ID NO: 324550 - DNA, 1085 bp, Homo sapiens
  misc_feature (25)..(25): n is a, c, g, or t
  misc_feature (28)..(28): n is a, c, g, or t
gcggccgcctactactactaaattngcngccggtcgatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324551 - DNA, 1100 bp, Homo sapiens
  misc_feature (22)..(22): n is a, c, g, or t
  misc_feature (26)..(27): n is a, c, g, or t
  misc_feature (30)..(31): n is a, c, g, or t
  misc_feature (36)..(36): n is a, c, g, or t
  misc_feature (41)..(41): n is a, c, g, or t
gttatggatagatgtaaggaantttnnctnntatangtttngtgaaaagacacaacttcacaaaacataataaaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324552 - DNA, 1700 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaagtcgacgcggccgcgaattta

SEQ ID NO: 324553 - DNA, 1627 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtagtaggcgcacgggatcctctagatct

SEQ ID NO: 324554 - DNA, 1532 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctttaaatgccctttaagtgtatttttgttgttacttttctgtttatatt

SEQ ID NO: 324555 - DNA, 898 bp, Homo sapiens
aatagagattcaggtgcattcgcatcaaacataataaatgaaagtcagaccaggatccagatccaggggtaccccatttactgtcaggtccatgttcttagaagtgaaacaaggattcacctttaacatctttttcaaaataataagccacatcagagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324556 - DNA, 742 bp, Homo sapiens
  misc_feature (25)..(25): n is a, c, g, or t
  misc_feature (28)..(28): n is a, c, g, or t
gcggccgcctactactactaaattngcngccggtcggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324557 - DNA, 937 bp, Homo sapiens
tttttctacactccttacatacaaagggctcctctcctgtgtgagttctctggtgtctgatgaggtttgacttctgaatgaaagctttcccgcaatctttacactcaaaaggtttttctccagtgtgaattttctggtgcgtaaggaggtttcccttctggctaaatgattttccacattcattacattcgaaaagcttctcgccagtatgggtgttcaatttctacacaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324558 - DNA, 769 bp, Homo sapiens
ccgggaaccattcttcgctcatatctctccacatagcagtaaaggatccggtctcagtatccacctaagccaggtttagatagatctcctttacaaagaaccgagtttctagcttggacttggaaaaagagatagaaaaccccttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324559 - DNA, 284 bp, Homo sapiens
tcaagcttctaacgatgtacggggacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324560 - DNA, 350 bp, Homo sapiens
cgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacggtgagtgcccgccgccgccgccgtcgccgcctccaggaagccctcggggccgcggcctgcaaaagccgccgcgcgtgatgggccctcacagggtcgggggagccagtgcttttcagaatgcctgtttaggacgagctcgggctcatgcatccgacctgaaccaaatgcagcagcagtagctttgggtggccaacaccaagctcagaaaca

SEQ ID NO: 324561 - DNA, 1003 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaacactatttgttaagtaagggtgataaggtgttcacggtgtaatactttgagatatagtgttcgcggaaagttgtgggctatttgaactaaaattaacctaaaa

SEQ ID NO: 324562 - DNA, 2065 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324563 - DNA, 2168 bp, Homo sapiens
  misc_feature (2017)..(2017): n is a, c, g, or t
  misc_feature (2020)..(2020): n is a, c, g, or t
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaacaancancaaaaaaaaattttgggggcttggcccaaaaatttttaaacatctgttgggcgcggcccaaggttgtaagtgggctcggtccaggaaccggggcggaaatgggggttccccaaaaagccgggcgggtttaaaaccaggggtgggcggc

SEQ ID NO: 324564 - DNA, 2035 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaagtcgacgcggccgcgaattta

SEQ ID NO: 324565 - DNA, 2012 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggaggtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324566 - DNA, 1941 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324567 - DNA, 1703 bp, Homo sapiens
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagccatttaggtacaagcccatttaggtacagccatttaggtacagccatttaggtaa

SEQ ID NO: 324568 - DNA, 2060 bp, Homo sapiens
  misc_feature (1448)..(1448): n is a, c, g, or t
  misc_feature (1458)..(1458): n is a, c, g, or t
  misc_feature (1465)..(1466): n is a, c, g, or t
  misc_feature (1470)..(1470): n is a, c, g, or t
  misc_feature (1474)..(1474): n is a, c, g, or t
  misc_feature (1478)..(1478): n is a, c, g, or t
  misc_feature (1481)..(1481): n is a, c, g, or t
  misc_feature (1486)..(1486): n is a, c, g, or t
  misc_feature (1489)..(1490): n is a, c, g, or t
  misc_feature (1497)..(1497): n is a, c, g, or t
  misc_feature (1511)..(1511): n is a, c, g, or t
  misc_feature (1513)..(1513): n is a, c, g, or t
  misc_feature (1522)..(1522): n is a, c, g, or t
  misc_feature (1526)..(1526): n is a, c, g, or t
  misc_feature (1528)..(1528): n is a, c, g, or t
  misc_feature (1535)..(1535): n is a, c, g, or t
  misc_feature (1542)..(1542): n is a, c, g, or t
  misc_feature (1544)..(1544): n is a, c, g, or t
  misc_feature (1553)..(1553): n is a, c, g, or t
  misc_feature (1558)..(1559): n is a, c, g, or t
  misc_feature (1586)..(1586): n is a, c, g, or t
  misc_feature (1588)..(1589): n is a, c, g, or t
  misc_feature (1598)..(1598): n is a, c, g, or t
  misc_feature (1619)..(1619): n is a, c, g, or t
  misc_feature (1626)..(1626): n is a, c, g, or t
  misc_feature (1630)..(1630): n is a, c, g, or t
  misc_feature (1633)..(1633): n is a, c, g, or t
  misc_feature (1638)..(1638): n is a, c, g, or t
  misc_feature (1641)..(1641): n is a, c, g, or t
  misc_feature (1650)..(1650): n is a, c, g, or t
  misc_feature (1652)..(1653): n is a, c, g, or t
  misc_feature (1655)..(1655): n is a, c, g, or t
  misc_feature (1672)..(1672): n is a, c, g, or t
  misc_feature (1680)..(1680): n is a, c, g, or t
  misc_feature (1691)..(1691): n is a, c, g, or t
  misc_feature (1696)..(1696): n is a, c, g, or t
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaatttccccaaanccccccatanggttagnncgcncccnaacnccncaccnccnnccccccncccccccccccccncncgcccaganccanancacaccngacccananacgcaccgnccccnncccaccaccaccgacagacccgccccncnnagtaccaanccatcaggaggcccacccccnccacaanagcnccnccaanacncccccagcncnncnaaccacccccccccccnacccccanccccccccggnccccnccatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaacattcataaaaataaaaatccgagactagctggtgccgaattcctgc

SEQ ID NO: 324569 - DNA, 2162 bp, Homo sapiens
  misc_feature (1448)..(1448): n is a, c, g, or t
  misc_feature (1458)..(1458): n is a, c, g, or t
  misc_feature (1465)..(1466): n is a, c, g, or t
  misc_feature (1470)..(1470): n is a, c, g, or t
  misc_feature (1474)..(1474): n is a, c, g, or t
  misc_feature (1478)..(1478): n is a, c, g, or t
  misc_feature (1481)..(1481): n is a, c, g, or t
  misc_feature (1486)..(1486): n is a, c, g, or t
  misc_feature (1489)..(1490): n is a, c, g, or t
  misc_feature (1497)..(1497): n is a, c, g, or t
  misc_feature (1511)..(1511): n is a, c, g, or t
  misc_feature (1513)..(1513): n is a, c, g, or t
  misc_feature (1522)..(1522): n is a, c, g, or t
  misc_feature (1526)..(1526): n is a, c, g, or t
  misc_feature (1528)..(1528): n is a, c, g, or t
  misc_feature (1535)..(1535): n is a, c, g, or t
  misc_feature (1542)..(1542): n is a, c, g, or t
  misc_feature (1544)..(1544): n is a, c, g, or t
  misc_feature (1553)..(1553): n is a, c, g, or t
  misc_feature (1558)..(1559): n is a, c, g, or t
  misc_feature (1586)..(1586): n is a, c, g, or t
  misc_feature (1588)..(1589): n is a, c, g, or t
  misc_feature (1598)..(1598): n is a, c, g, or t
  misc_feature (1619)..(1619): n is a, c, g, or t
  misc_feature (1626)..(1626): n is a, c, g, or t
  misc_feature (1630)..(1630): n is a, c, g, or t
  misc_feature (1633)..(1633): n is a, c, g, or t
  misc_feature (1638)..(1638): n is a, c, g, or t
  misc_feature (1641)..(1641): n is a, c, g, or t
  misc_feature (1650)..(1650): n is a, c, g, or t
  misc_feature (1652)..(1653): n is a, c, g, or t
  misc_feature (1655)..(1655): n is a, c, g, or t
  misc_feature (1672)..(1672): n is a, c, g, or t
  misc_feature (1680)..(1680): n is a, c, g, or t
  misc_feature (1691)..(1691): n is a, c, g, or t
  misc_feature (1696)..(1696): n is a, c, g, or t
  misc_feature (2016)..(2016): n is a, c, g, or t
  misc_feature (2018)..(2018): n is a, c, g, or t
  misc_feature (2024)..(2024): n is a, c, g, or t
accggaatctaggtggggccgcccggagcggcgtcctcgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaatttccccaaanccccccatanggttagnncgcncccnaacnccncaccnccnnccccccncccccccccccccncncgcccaganccanancacaccngacccananacgcaccgnccccnncccaccaccaccgacagacccgccccncnnagtaccaanccatcaggaggcccacccccnccacaanagcnccnccaanacncccccagcncnncnaaccacccccccccccnacccccanccccccccggnccccnccatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaaaananaaaaanaaaaaaaaaaatacaaaaatggacattggacttgcaaagcataacattatttaaaatagcaaagcacccattgttagaaaacccccttaaaaaaaaatagtggccgccaatttaaggcctctgtggcacatatccttt

SEQ ID NO: 324570 - DNA, 1650 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggcctgttttacatttggtgagaacattcc

SEQ ID NO: 324571 - DNA, 1654 bp, Homo sapiens
tagaaaccctccagtccttagctcgtttagaacacaagactccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggcctgttttacatttggtgagaacattcc

SEQ ID NO: 324572 - DNA, 1384 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtt

SEQ ID NO: 324573 - DNA, 1433 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaaaaaaaaaaaaaaaaaaaaaaaaaaaaaaaaaaaaaaaaaaaaaaaaaaaaaaaaaaaaaaaaaaaaaaaaaaagaagaaaaaaaaagaggggggggggggccatcgaaaaatctcccggggggggggaccaaagaagagcgacgaccatcaatgttgtcgtgaaaagaagaggggggcatcgccacacaagggagagagaggcgcgcatcaatataaacgaaacacgagaggaagggaggggctaagaaaacagcagcgcgggggcggaggaacaaacagaggaagcgcaggggacaacaatctgggggaaagagacgcacacacatggggtgggggtaacaaacacgatggggaacccaagacaccagagggggattagagggccgcggcggaaaacaacaagtggacgaaaga

SEQ ID NO: 324574 - DNA, 1070 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacaaagagaaacagaaggagaagaaaaggagggctgaggaggacttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggcctgttttacatttggtgagaacattcc

SEQ ID NO: 324575 - DNA, 853 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggcagggactgcttcagtttctgtcgacccgcccgcgaatttagtagtagtagtcgacc

SEQ ID NO: 324576 - DNA, 995 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagagaaaaaaaaaaaaaaaaaaaaaaaaaaaaaaaaaaaaaaaaaaaaaaaaaaaaaaaaaaaaaaaaaaaaaaaaagaagaaaaaaaaagaggggggggggggccatcgaaaaatctcccggggggggggaccaaagaagagcgacgaccatcaatgttgtcgtgaaaagaagaggggggcatcgccacacaagggagagagaggcgcgcatcaatataaacgaaacacgagaggaagggaggggctaagaaaacagcagcgcgggggcggaggaacaaacagaggaagcgcaggggacaacaatctgggggaaagagacgcacacacatggggtgggggtaacaaacacgatggggaacccaagacaccagagggggattagagggccgcggcggaaaacaacaagtggacgaaaga

SEQ ID NO: 324577 - DNA, 581 bp, Homo sapiens
aatgtgatgacctgccatcgggcagctcgtagctttctccagagaagagagatgcgtcggtggccatctcctgctcgaagtccagggcgacgtagcacagcttctccttgatgtcgcgcacgatttcccgctcggccgtggtggtgaagctgtagcctcgctcagtgaggatcttcatgaggtagtcggtcaggtcccggccagccaggtccagacgcaggatggcgtctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggcctgttttacatttggtgagaacattcc

SEQ ID NO: 324578 - DNA, 1526 bp, Homo sapiens
gctttttcctccccacagacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggcctgttttacatttggtgagaacattcc

SEQ ID NO: 324579 - DNA, 1136 bp, Homo sapiens
  misc_feature (916)..(916): n is a, c, g, or t
  misc_feature (1097)..(1097): n is a, c, g, or t
cgggagcaaacttaggctaggtacgaggctgggtggtccaagcttattggagggctatcttgccttacggctccaagccgctttttacggcgtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgcccgcttacgccacaaccgctctctccgccagaccaccgcctcccccgcccaatatacnccactcgtccttccccgcccggcccaccgtgcccaccatcgcgccgaccccacctttctcgtcactcacacaaccccggcggtctttcacccgaccgtcgaccccgctcctctctgccgcccatccttttcgcgcgctcgctcgctacagctccttcttccccccctgttccgaccgctcngcccacatcactcacccccgcctgcaaccgtcccgcact

SEQ ID NO: 324580 - DNA, 385 bp, Homo sapiens
cgggagcaaacttaggctaggtacgaggctgggtggtccaagcttattggagggctatcttgccttacggctccaagccgctttttacggcgtttttcagctcgccattcacttcgctgtgaagatggcgtcgggcagcggggtaggtgttgtgtctgaggaggaggttttgcggggtggggaatggtttttcagacctgaatagagacaaactcctgcacccgactggcttcccgatatctcctcgagatcccagggttcaggttcaagaactccccagtaataggccttggcagagggtcagtagaatcgcggaggtttctcgggttggggtcttgaggctacctcagtcttctcgtacagtccaaagaggcttcgctttcaa

SEQ ID NO: 324581 - DNA, 3739 bp, Homo sapiens
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcaggggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaag

SEQ ID NO: 324582 - DNA, 1843 bp, Homo sapiens
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggaggtaggtaaaagatcagctgtcatgtctgtgcttcttccatattagagagtgtggtgatgtaattttagtcagggtttttggttttggttttggttcagatatttcagacacagtctaaagtaaattatggccagtgtttgttctactttacaatagaaaagcatccatggagttttgataacagtcaaagaccctttcatgatctttacatggtgagcagctagtattgaaaacttgggtagccataatttatttcccagttttattatcttatattcttatcctagtttgcccagaaatgtggatgttgttgggctgcctacaagttatagctctcagtctcttttcctctgtccttctcatttcaatcatctttaataataaaaggaactttgtcagccaaaaaaaaatagatgtattttctgtatttggcaatattccttcaagaaaactctaactgtataaattaacttcgaaggactgctaagaaaaatgccatatcttaagcaaagagcttacattttcttcttgggtagcattctaatggatcactaccaaaatatttgacttagaatcccaggttagctttttctgcagatagtggtctttatacctttagcctg

SEQ ID NO: 324583 - DNA, 445 bp, Homo sapiens
accaaatccctggaaggaaatatctcatgaaggtaatatcttccattcaaaaatgataataatctaatccttatttgtttatgttattaatttaaattaatttaattgtaaattattaacttaatacatgctcattgtaaagtgcccaccagagtggagacacaaagacacgaattaatttgggtgggacacatacacataacagaaattgggttatatatattaagaagtaagtgaacaaccagagagaatgtattttggtacatttcattagaacttataaatacttataccttaatataatagtaataatgaattattagtaagggcttacttatatgtgcctagttctgtgttaaaaacttttaaactattatcaacacaagaatgttatgacattgatattttaatgatcatataacatatgttagtataccaagttctt

SEQ ID NO: 324584 - DNA, 311 bp, Homo sapiens
ggccaggatgtgggagatagccatccagcatgcccttatgcccgtcattcccaagggctcctccgtgggtacaggaaccaacttgcacagtgagtctgccagttttctaaccagcccaaagctcatcatgtgcctaccccttgcttagtaaacatgtgccctgcccttcctaagaacagaatgaagaaagacttcttggggatgacttagtttattgtagaatgtagggtgtctaaataaaagctgctgcacatactaagatgtttagtttgttaaattatcctattttattatagctattttatattaaa

SEQ ID NO: 324585 - DNA, 2986 bp, Homo sapiens
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcagcttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagatgttgacttgatacaatataatacctatatcttggggtgcttgagtagtcattgcactgcttgatcctcacagcaatcctctggtctcagttttcttttctgatatggtgatgctaattcctaccttactgggttattatatacaatatcaggacatgtaacttgttcatgttacagattgccatgaaaatagtgagaataagaaaagaagcacaagtatcttttttcaggaataaagaagaaacaactataaacaccagggaaatacaaaaagttgtataacaaagtcgtgtataataaagatgcaactaacaaa

SEQ ID NO: 324586 - DNA, 596 bp, Homo sapiens
cgagacaccatctcaaaaaaaaaaaaagaaaaaaagaaaagtaaaaagcaagggcagtagacctggcctgtcagatgagtatatttttttttaaatctaggaattcatataaaattgtctttatggattattttttctgttctttctacctaagtagaagttatcacagtatggaagataaatcctaaactgccaaattgaagatggtttgtagctcatactagatgccacctatgagttgactttttccacagcataccagcattcctgaagtctgttctgtcctctttcagttactcaggggctatttctacatcacagtttgcttgaaatttcagtttgaaaatttgagaaatccagttttttagctctaacttgaaattagatctaacatctgcataatttttatgtttttcttgtgtgtgagccagtagatgagcttaaacctttctaaaaattgggatatactatgtattcgcccttaaaactattttttgatttaagtagcaaaaaatgagaaccttcattttcttaggatagtatttctctcttttgtttttacagtgttacatagtgcttccatttcaagaatagcc

SEQ ID NO: 324587 - DNA, 298 bp, Homo sapiens
tcccgcagaaaaacacagagacacttttgaggctggagccaagggtgtgggtgcctgtgtatgtgtttccgagtgtccccttgtgatgtgcgcatgtgtgtaatgtgtatgtgcatgtgtgtgcacatctatgtgcaaatatatagtgtgtcatattgcacatgtgtggatatgggttggtgtgcacacacatgtggcactgtgcaatccatgcagtacatatgtgtgatatgtgcatattttgcacacagatgtgttgcacatttgtgcatgtgcaaacgtgtgcacccataagaat

SEQ ID NO: 324588 - DNA, 448 bp, Homo sapiens
  misc_feature (25)..(26): n is a, c, g, or t
ggattattctattgacttgggttanncgtgtgttacggtggctggcacgtaattgaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagccattcctcgcaacagctgttgcgaggaatgctgaggaataaatagctgtgtagcaagttttgctacagaatggtggtgccatgccctgaagtgaacactaaggaagcagcagcagttctgaggcaagaaagaggttcaattttcaacacatttgacttaggagctcgtgagggag

SEQ ID NO: 324589 - DNA, 277 bp, Homo sapiens
gcggccgcctactactactaaattcgcggccggtcgaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcagtcgacgcggccgcgaatttagtagtagtaggcggccgc

SEQ ID NO: 324590 - DNA, 695 bp, Homo sapiens
cacatggctgatgctccagaccccacttatctcccagcaccctctagcagactagcttcatcatggcttccacggcgtcagcccctccccacttccaatctattccacctctagccatgcaccacctactcagcaagttctgccaccccagggttacatgcagccccaaatcaacaaaactgctcgccagaacactacgagccacagcttaaaactcaaaggacctggcggtgcttcatatccctctagaggagcctgttctgtaatcgataaaccccgatcaacctcacttatctcctcgaggagataagcaggaatggagacgggcagggtggaagacatgcgaaggaagtggagcggtcaggactcccttgtttaattggtgatgacaggaagagaaagagaaagagtagactgtgtgggagagagagaagagaaggaaagattggtcattgttactccctggttcttggctggggtaactaggtatatgatgtgtgtgtatttgctgagatgtgggacacataaggactagaagagttgcttggtttttgataaccaagtctgaggtgcttttgggaatcatggcccacttaactttccactccttttcatctgtgaagctctgatgtctgagaaaggtcaagggctccttggtagagaactataagcagtacgatccactttcaatactt

SEQ ID NO: 324591 - DNA, 344 bp, Homo sapiens
gctggaccgggatcttgagagtcgatatgctgaggatgcaaagcgggggatcatggtacgccattatgcatatagtcctgacatgtcaacagcctggatgtacaaatcaacaaaactgctcgccagaacactacgagccacagcttaaaactcaaaggacctggcggtgcttcatatccctctagaggagcctgttctgtaatcgataaaccccgatcaacctcaccacgacacagtgcaccacgacacagtgcaccacgacacaggcaccacgacacagtgcaccacgacacaggcaccacgacacaggcaccacgacacaggcaccacgacacaggaatcct

SEQ ID NO: 324592 - DNA, 918 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (843)..(843): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324593 - DNA, 954 bp, Homo sapiens
  misc_feature (10)..(10): n is a, c, g, or t
  misc_feature (879)..(879): n is a, c, g, or t
cactatgtgnattggctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggactaatcaacatagttatgttgattggcaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324594 - DNA, 759 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatcaggtggcaacaaatggggtatattttcgtgcccctgtttatctccccccgcccccctcaaactcaaggttcgaatctggtttcagcagttttctaccag

SEQ ID NO: 324595 - DNA, 1140 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (844)..(844): n is a, c, g, or t
  misc_feature (1056)..(1056): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacatagtcagcgcaagtccccacgctgtgcctacaagtacacggactacgcgatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanaccccctgccgctttaaataaaggttggttgggcaagataaaaacattggtcgccccgcccagtgcaaatgaactcttaactgcaagcaagtttaatgctgcccgccccaattacaagctacatttgtcaaaatctttgcagggcccgtatttaccctatagcaccccctctaaccccttttgagaccaaatgttaatatggttgtaataanttaacatgttggccggctcggcctagggactttcttaagcaactttattcattcggccccaatttgcttacttggcctttcgcc

SEQ ID NO: 324596 - DNA, 757 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggggttctaactaatgcgcgaacgttacgtcacatgacgaccatagctcaaagttgtagcccatcaggtggctgatagtggatcacatcttgtacgtgccggggattgcgtatagtcgttagcatactaaagtctcgaaggtgaatcggagctaa

SEQ ID NO: 324597 - DNA, 687 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggataacaaagtaaggcgttagtaccctaagtaaaagtacgaataggtctagctgtagaaaaagagcggcgagttctcggcacaa

SEQ ID NO: 324598 - DNA, 763 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagccattctggttcagctcctctttccatttcctctgagaccacaggacctcctcaagtcccctacccaatgcctatgccctctgtgccccctacccaatgcctatgctcacagatgccttacttcctgcctcatagcatcaaaaaggccatgggaaaggataaccctgtacagcccaaacctgttaggtctacctgg

SEQ ID NO: 324599 - DNA, 591 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcagtcgacgcggccgcgaatttagtagtagtaggcggccgc

SEQ ID NO: 324600 - DNA, 613 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgaagccatttaggtaacagccatttaggtaacagccatttaggtgacagcca

SEQ ID NO: 324601 - DNA, 769 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcagtacatgcaaggctgatccgcttaagcggatagggtgctgataccccatgcagatgaaaatccatgtataacttttgactccccaaagatgtaactactaacattcgattaacacatattttgtgtgttatgtgtatttgaggctgtcctcttacaataagtaagctagaggaaagaaaattttattaaaaaatcattagacagaaaatacgctacg

SEQ ID NO: 324602 - DNA, 804 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagccaaccgtggactagtactagtccacggttggctgcttttaggcctactatgggtgttaaatttttttactctctctacaaggttttttcctagtgtccaaagagctgttcctctttggactaacagttaaatttacaaggggatttagagccaaccgtggactagtagccaaccgtggactagtagccaaccgtggacactagtccacggttggctagtacgctggaatggaattg

SEQ ID NO: 324603 - DNA, 677 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (654)..(654): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcacccgggtacttgcgcttactttgtagccttcatcagggtttgctgaagatggcggtaataggctgagcaagaggtggtgaggttgatcgtttatcgattacngacagctcctctagaggatatgg

SEQ ID NO: 324604 - DNA, 727 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccaccaggtggttgagtagtaggaatgcggtagtagttaggataatataaatagttaaattaagaatggttatgttagggttgtacggtagaactgctattattcatcctatgtgggtaatgaggagtatgctaagattttgcgtagctggtttgggaatccacctcaaccacca

SEQ ID NO: 324605 - DNA, 740 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (572)..(572): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaatagtcactatgtggatggngggtaatacgaatgtcacttgcagactaagagaatgaaagctctcatgcaatgcttcatgatcctatggtacgatgttggggcacgatttcatggccatctagcaggcatatattctggatgatatagctacagggtgatagagtctccttcaacttggatccttgag

SEQ ID NO: 324606 - DNA, 664 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcaacacaacatacccccagcaggcgtgaccgctccgtttactgacgcttactgacgcttactgaccgcttactgacaacaacatatgctccgcttactga

SEQ ID NO: 324607 - DNA, 784 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcacactctagagggatatgaagcacgcagtcctttgagttttaagctgtggctcgtagtgttctggcgagcagttttgttgatttaactgttgaggtttagggctaagcatagtggggtatctaatcccagtttgggtcttagctattgtgtgttcagatatgttaaagccactactcgagtctattttgtgtcaactggagttttttacaactcaggtgagttttagctgtcg

SEQ ID NO: 324608 - DNA, 621 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (598)..(598): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaaataggctgagcaagaggtggtgaggttgatcgtttatcgattacngacagctcctctagaggatatgg

SEQ ID NO: 324609 - DNA, 759 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (684)..(684): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcatatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324610 - DNA, 607 bp, Homo sapiens
  misc_feature (41)..(41): n is a, c, g, or t
  misc_feature (47)..(47): n is a, c, g, or t
  misc_feature (85)..(85): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcatgatcttctgcacgatgaggtgatcttctgcacgataaggtgatcttctgcacga

SEQ ID NO: 324611 - DNA, 746 bp, Homo sapiens
  misc_feature (671)..(671): n is a, c, g, or t
ccgatcccccaggtagacctaacccaggtaggggccacagttgctggatgtttatatagagagtaggttgatttattttacatgcttttgagttaatgttggaaaactaatcacaagcagtttctaaaccaaaaaatgacatgttgtaaaaggacaataaacgttaggtctacctggcaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324612 - DNA, 623 bp, Homo sapiens
  misc_feature (25)..(26): n is a, c, g, or t
  misc_feature (548)..(548): n is a, c, g, or t
ggattattctattgacttgggttanncgtgtgttacggtggctggcacgtaattgaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324613 - DNA, 837 bp, Homo sapiens
  misc_feature (762)..(762): n is a, c, g, or t
catggatgggttgaaaagagagacaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagttagctaggtttctggttcccccacagtaggtctagctgggttaggtctacctggccaggtagacctaaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324614 - DNA, 604 bp, Homo sapiens
  misc_feature (529)..(529): n is a, c, g, or t
gcggccgcctactactactaaattcgcggccggtcgaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324615 - DNA, 538 bp, Homo sapiens
  misc_feature (41)..(41): n is a, c, g, or t
  misc_feature (47)..(47): n is a, c, g, or t
  misc_feature (85)..(85): n is a, c, g, or t
  misc_feature (527)..(527): n is a, c, g, or t
gcacggattagctcttagtagattacacatgcagcatcccnactccnggagttcaccttctaatcacccgatcaaggggacagcntcagcagcaacatgcagctcaaacgcttgcctagccacacccccggggaacagcagtgattacttacaataaacgaaggttaactagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaataaactacgaaagtggctttaacatatctgaacacacaatagctaagacccaaactgggattagataccccactatgcttagccctaaacctcaacagttaaatcaacaaaactgctcgccagaacactacgagccacagcttaaaactcaaagtattttttcagtttttataccaataaagtgaccctgttttcantggaaaaaaaa

SEQ ID NO: 324616 - DNA, 660 bp, Homo sapiens
  misc_feature (585)..(585): n is a, c, g, or t
taagaggatggctagagacatagatttgtaataaaacatagtaagaaagtctgggaggcggcttctggcgatgccatagtggcttaaggatgtcagagctgaggttccaccattttagttggccttcttccgtcatggtggcgagctagacgttccggtaacgtctacttgcaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324617 - DNA, 655 bp, Homo sapiens
  misc_feature (580)..(580): n is a, c, g, or t
cacatggctgatgctccagaccccacttatctcccagcaccctctagcagactagcttcatcatggcttccacggcgtcagcccctccccacttccaatctattccacctctagccatgcaccacctactcagcaagttctgccaccccagggttacatgcagccccaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324618 - DNA, 225 bp, Homo sapiens
atctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcacaacctcaaattagagaccaatttggag

SEQ ID NO: 324619 - DNA, 591 bp, Homo sapiens
  misc_feature (516)..(516): n is a, c, g, or t
gctggaccgggatcttgagagtcgatatgctgaggatgcaaagcgggggatcatggtacgccattatgcatatagtcctgacatgtcaacagcctggatgtacaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaactacgatagcccttatgaaacttaagggtcgaaggtggatttagcagtaaactgagagtagagtgcttagttgaacagggccctgaagcgcgtacacaccggccgtcaccctcctcaagtatacttcaaaggacatttaactaanacccctacgcatttatatagaggagacaagtcgtaacatggtaaagtgtacttgggaagtgcacttggacgaacc

SEQ ID NO: 324620 - DNA, 688 bp, Homo sapiens
ccggccccggccggccagggaaggcggcccctcctcggtcgccccgcctttcactcccgttacacccgggggaaggtgttcccgagccctctcccaccctcatcccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtggagcaccatgcaaagtgcggagatgcagagaggaaagactactcggtccttgttccttgctgtcccagaggtcacagtgctgtggggagggggacaaggacataccctgtcaggctgcgtatataaatacacaggtgctaagcaaaatgggaacggagaagggaaaggttccctccaccttgagagacccacagaagggtgttctagagatggatgagtcagactgcaagagagcaaagatatcttcctgaatacattcaatatcaaagcatcatgtgccctgtgtgtgcaaaataataataatcataataataaagtaaaataaaagattggctgt

SEQ ID NO: 324621 - DNA, 542 bp, Homo sapiens
tacatttctatgggagggactgatgctgtcatcagggagcttgggggacaggcttcttggagtgtccccctggtgggacctggaatgtgttgaacttggctgagtggtgcaagggatcccctggtgccatccctgccaaagaccctatcagtgtcatgagcctgaggatgaaatctcccgatggggaacctcagtttttgcccttaaggccttcaacctattggatgaggcccacctgcattcatctcctttacttaaagttaactgattggagagcttaaccacatctgcatgctaccttccctgaaatacctagacgagtgtctgaccaaactactggactccatggcctagccaagctggctcattacatttatttatttacttagagataagtctcgctcccccaggctggagtatgatcatagctcattgcagccttgaattcctggactcaagtgatcctcctgcctcagcctccacatagctgggatgacaggggcaagccacatgcctgctgatacattaaatctaaccatcac

SEQ ID NO: 324622 - DNA, 2826 bp, Homo sapiens
ccggccccggccggccagggaaggcggcccctcctcggtcgccccgcctttcactcccgttacacccgggggaaggtgttcccgagccctctcccaccctcatcccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324623 - DNA, 3029 bp, Homo sapiens
ccggccccggccggccagggaaggcggcccctcctcggtcgccccgcctttcactcccgttacacccgggggaaggtgttcccgagccctctcccaccctcatcccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324624 - DNA, 2937 bp, Homo sapiens
ccggccccggccggccagggaaggcggcccctcctcggtcgccccgcctttcactcccgttacacccgggggaaggtgttcccgagccctctcccaccctcatcccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324625 - DNA, 2451 bp, Homo sapiens
tacatttctatgggagggactgatgctgtcatcagggagcttgggggacaggcttcttggagtgtccccctggtgggacctggaatgtgttgaacttggctgagtggtgcaagggatcccctggtgccatccctgccaaagaccctatcagtgtcatgagcctgaggatgaaatctcccgatggatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324626 - DNA, 2518 bp, Homo sapiens
ctggctcccatccagtgctctttaggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324627 - DNA, 2876 bp, Homo sapiens
ccattgttgttgtgcttgttgctgaaatccaaaatctggaagagaatgaagtagagagaaaggcaaataacatgcatttaacaattcctgtgtatattgtacctacatgcatcacgagctctttgacaaatgtttgttgagtgtgtcaatgtgctaggttcttgttggaaacatggaggggacaccttctgcatcccataataaccttgcaaagagatgataacatccattgtatgcacgcactcaggctcacaaaggtagataaaccatccagagccacctgccaggttggcatgacaccagaaggaagaccacggaatacgtcctggtggagatgtggagagaaacattttttatagcaggatcacagaatctcacgctgttttcttcctccttttctttgcagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324628 - DNA, 1839 bp, Homo sapiens
ctggctcccatccagtgctctttaggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324629 - DNA, 886 bp, Homo sapiens
ctggctcccatccagtgctctttaggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccggtaagtggcagagctgggattcgaacccagctctctttcactccagaacctgtgctctaaattgccttgctttctttgccttaaaaaggggagacctgcgactttgttttctgttttgatggtactcacacagattcctgggttgaaaggagagggcccctgggtccaaaaattcagaagggtggtggcatttgagaaaaacatccccattcccagtgggtgccgtggccgggacaaacccggagcttaggcgcacctgggttcaggatcgagctcactgtagccagcaggagcctgggtctgttctcccaggagggttgctccgaggccccaggagctctaggaaccagacccctgggaccccacagcagggcccaggtgcctcgtcgtgtgctgtgtgcctcacattctgcctcagccacagaggagcccggcaggcaggactcaatctcactcagcaccactctggatggttgcgtagttacaccgtgtggttgtagtatttatggtttagttgttttgcaaaagccaaaggaagtctgtgggctgagttctaccttcccttctttgaggatagttggtctgctcagtcagggacaagcagagctcagctagagaaaaaaaaaaccctccaa

SEQ ID NO: 324630 - DNA, 2721 bp, Homo sapiens
ctggctcccatccagtgctctttaggtgactctcttctctccccacactgagtggcttgaaagggctcagaggcttcacatgagcacttaacatttactgtgtatatctgagccaagtagggaaagaaactgtctcaccaatcctcacgccctctccccatgctaagtctcccgagtattttcttctgtttttcagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324631 - DNA, 2747 bp, Homo sapiens
gcagagggagtcagccgtgaccctgagggcagtgactggctcgccgcgtccctgcatcaggcattcgcccggctttctcgtgattgtttccgggcacccctggcctctcccgacttctccccctcgcgggtccccaagccccgcaagtttgcgacgagctggttctccagggagacagcgagcgcccacccccgctctgcggctgggtgtgtgtggtgagaggaagagacgggaggaggaggcgaggccgactcgccaacgaggaaaacgggttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324632 - DNA, 2976 bp, Homo sapiens
ccggccccggccggccagggaaggcggcccctcctcggtcgccccgcctttcactcccgttacacccgggggaaggtgttcccgagccctctcccaccctcatcccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324633 - DNA, 2654 bp, Homo sapiens
tacatttctatgggagggactgatgctgtcatcagggagcttgggggacaggcttcttggagtgtccccctggtgggacctggaatgtgttgaacttggctgagtggtgcaagggatcccctggtgccatccctgccaaagaccctatcagtgtcatgagcctgaggatgaaatctcccgatggatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324634 - DNA, 2646 bp, Homo sapiens
agttcgacggagactctcattgattggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324635 - DNA, 1881 bp, Homo sapiens
tgagaggtgaatggtttaccagagacccacagaatccacccttccagtccattcctaggggctggagtttggctttctggacgtgcacgccctctcctgcctgagaattccctttcgttgtgctcaaggcaggctttgggtggtggaatcaaggccaggcctgatatcggcctcctcccagctcagccactgctggctgtgtgacattgggcagatcacttagcctctctgggcttcagttttcttatctgcagcatgaggagagggaaacctgggacatgaggtcattttaaggattggcgatgattccagccatcatcaggtggcttggtgcatatgtcttcactcactgacagtgtctagtcccacctcacactgttccctggagcccccttctcctgagcagcctcccatctcactccctggcctccttggatttttctgtgtgtcagctcagtgatcctcctcacacggtcctgtagggccctcctctgcatcattgctctccatagcacttattagctcagcacctctgtctcttagtgatgtggatgagtgtccatctttcctacgagcatggaagcccacaagtgcaggcgtatctattaggctcatggctgtgcctccatggccacaacagtatgtacatctgacaggcgctccatgtcctttgccccccagaactcactaagggccgtgtcttcccatccccgcagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccatggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaa

SEQ ID NO: 324636 - DNA, 1818 bp, Homo sapiens
ttgtacaaacataaaaatatacaaaagctattgtctacttgaaatttatagttaataaaagcattataaatgtaatttctgttgaaagaccttttagaaaatataggccattaaagtgaagaatagtcttaagacagagaatacaaagataaagagggctctagtacctgtacttgtatcccagaacttactatatgcattttgtactagaggaaaactctgaagcagttgcttaaactttgttcaacatcagagaatttatattggagagaaatcctacaaatgtaataaatgtggaaaaacctctgttcagaaactgcaggttaagaaaccagaggccaggcgcggtggctcacgcctgtaatcccaacactttgggaggccaaggagggtggatcacctgaggtcgggagttcaaggacagcctgaccaatatggagaaacctcgtctgtactaaaaatacaaaaattagcaggacatggtggtgcatggctgtaatcccagctactcaggaggctgagacaggagaatggcttgaacccaggaggtggaggttgcggtgagctgagaatcgtgccattgcactccagcctgggtaacaagagtgaaactctgtctcaaaacaagataaaaagaaaagaaacaccagagaatttttactagaatataatttgtaggtgcagtaaatgtgaagaaatatttaggctaaaattaagactatgtaaacatcagaggatttacagtagaaagaactaaggaactaacacttcagactttaaaataaatcagagtattaagtataacaaaagttgaacctgttagaaaatttccttgtatataagttgaaaagtaggtttttgaagagatatattcgaaatatattttttcacttgaaaaaagtaaaaatttttttcaaaagcaaataattcaactctaaaattatactatttcaacattctcatttatgtgaaagcatgtgataaattgttgctgcgtcagagatatgagaaactcctttgcattaggtgggcattattcatagacttctacatgaaagagaagagaaataaaagatgcaccaggaaaatctgagcagagaggcttttagtggttgacttactgagtgatgcctgaagtaggtgttcagagtaatactttgcgttatactgagagagaatctgaattttagtagtaaattgttttgccaactgtatatttatgtaataagtgcaataaaatgcagtaaattttaaaattctcttaagataatgtgtgaacttaatttttgaaataaaaattgttattgtgttaaaatttttgtgccgtgaatgaagtgttttattatgccaccaactttcacctatccaaccttactcaagggtgtacgttaaagatggtaacaatgtactatctggtaatataattgaatgacatctctagtcttttttagtggctttcaacagcaaataaattgaagaatattgtttgcatgttacatttttattcttattgaaatttttcaaaaggttttgtgagtacatagtatgtgtatatatttatggtatatatgggttattttgatacaggcatacagtatgtaataatcacaccacagtaaatgagttattatcacctcaagcatttatcctttgtattacacacaatccagttacacactttaattatttttaactacaggtcattttatgtttgtaataaacattcatacattcctgagtcttgaatacttttaaaaaatgtttcatatatatctttgaacatgtggcatgtcctcctgcaaacacatacagacattt

SEQ ID NO: 324637 - DNA, 1060 bp, Homo sapiens
caaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaaagaatgtggcaaagcctttaagtcatactacagcattcttaaacataagagaactcataccaggggaatgtcttacgaaggtgacgaatgtcgcggtctttaaatgctcctcaatcctttctaatcataagataattcataatgaagagaaactctaaaatgtgaaacacatgtgagaaggcttttaatcacacctcaatctgttgtagacataagagtaattatattgatgagaagccaaattaaaattaaaaatgtggcaaagacttccaattctagtcagttcttaatgtaattcctactgaagaaaac

SEQ ID NO: 324638 - DNA, 2204 bp, Homo sapiens
caaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaaagaatgtggcaaagcctttaagtcatactacagcattcttaaacataagagaactcataccaggggaatgtcttacgaaggtgacgaatgtcgcggtctttaaatgctcctcaatcctttctaatcataagataattcataatgaagagaaactctaaaatgtgaaacacatgtgagaaggcttttaatcacacctcaatctgttgtagacataagagtaattatattgatgagaagccaaaagtgaaactctgtctcaaaacaagataaaaagaaaagaaacaccagagaatttttactagaatataatttgtaggtgcagtaaatgtgaagaaatatttaggctaaaattaagactatgtaaacatcagaggatttacagtagaaagaactaaggaactaacacttcagactttaaaataaatcagagtattaagtataacaaaagttgaacctgttagaaaatttccttgtatataagttgaaaagtaggtttttgaagagatatattcgaaatatattttttcacttgaaaaaagtaaaaatttttttcaaaagcaaataattcaactctaaaattatactatttcaacattctcatttatgtgaaagcatgtgataaattgttgctgcgtcagagatatgagaaactcctttgcattaggtgggcattattcatagacttctacatgaaagagaagagaaataaaagatgcaccaggaaaatctgagcagagaggcttttagtggttgacttactgagtgatgcctgaagtaggtgttcagagtaatactttgcgttatactgagagagaatctgaattttagtagtaaattgttttgccaactgtatatttatgtaataagtgcaataaaatgcagtaaattttaaaattctcttaagataatgtgtgaacttaatttttgaaataaaaattgttattgtgttaaaatttttgtgccgtgaatgaagtgttttattatgccaccaactttcacctatccaaccttactcaagggtgtacgttaaagatggtaacaatgtactatctggtaatataattgaatgacatctctagtcttttttagtggctttcaacagcaaataaattgaagaatattgtttgcatgttacatttttattcttattgaaatttttcaaaaggttttgtgagtacatagtatgtgtatatatttatggtatatatgggttattttgatacaggcatacagtatgtaataatcacaccacagtaaatgagttattatcacctcaagcatttatcctttgtattacacacaatccagttacacactttaattatttttaactacaggtcattttatgtttgtaataaacattcatacattcctgagtcttgaatacttttaaaaaatgtttcatatatatctttgaacatgtggcatgtcctcctgcaaacacatacagacattt

SEQ ID NO: 324639 - DNA, 281 bp, Homo sapiens
ctcataccttttctctgcacacacagatacatgtatattttagccttggtaatttatatgcttctctgtggtcctggctcatcctttttgttgagtcatcgcatggcaggagtgcaagagagtgaacccagtcctgcaagatccaaggcgctttcaaaccataacaaattctaaacttaggtgtatagagtagaataggttaatatattaacaaatgtgcattgagtgtttgcattggccaaggcatgcaaatgtctcagtataaaatcagacagatttta

SEQ ID NO: 324640 - DNA, 736 bp, Homo sapiens
aaagaggcgccgcgccagttttgtgacgttcagcacggggcggtggcgggggctcccggcccattcggagggtttcctagtcttggagtggaagaattaatattcctcattggggcatgagccaggatgggggttacctgggagttgggaaccacaaaggggagccgatagccgagttgtattccaggtcacggcctttttatttttatggcgccttttttttttttggcccctcatttaattgggaagcttctcagaatgtttttgtaaagtcactaaccaagaccggacctttcagttcatattaaatggcccccgtagtcaccttactttcatgtagtttcagattttgcagcctgaatctaatcacctttttctaagaccgaaagatcttccttgaacttaagattcgttctttcatcgcttccccattaaaatggaggcttaagacaggtgcccagcagtgtttttaaaaattttcaccagtggtttggtcttagaacttactccctgggcacagggtgtggtcacggcaaataggatgtgtctggactggatattttaattagacaagcccagagtaagaagaacgtggtgtttatggaaagcacttcagctgaattattgagtagatggtttttatgtaattgaaactggtctacaagtttatcagattcatcgtcgaagtgactcagtaataaagctttatcaaatacaagtccgccaaggaagaaca

SEQ ID NO: 324641 - DNA, 949 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgc

SEQ ID NO: 324642 - DNA, 1009 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctggttggctcttgacaggacacggtgtactcccatggtgcaaggggctatacagggtatacccagatgtcttcaatgttccttaacaaggattggttgcctattttcacacggtatatcctaccgccggggagttttaattaccaacagggaacgcaatactccacgacggaacactaggtgcaccaggcaagtaaccggaaaatctttgttgatacactattatcg

SEQ ID NO: 324643 - DNA, 891 bp, Homo sapiens
  misc_feature (783)..(783): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcacatgaacggactagaagaccgtttgcaagagaagtggtgtccggaaattacttcatttgacagggtttgtccgaaattcacgttggtgggacttcataaggtgggcctttacgagtttgcgtcaacactgttgtctgaccgggccagggntcctggtgaggctcggctttaccaagtttcagtcctgcaaaatgtgagtttcagggaacccagcgggggtcaaacacaccaaacattccgaggcgaccggcccatttt

SEQ ID NO: 324644 - DNA, 355 bp, Homo sapiens
atctttagcatgaaaactttccacaggtctaaaaataaaagccattgttaatgggcaacttacttgtgtttaagaaccaggttgctgctatactttaaaatgttggtcactaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagt

SEQ ID NO: 324645 - DNA, 1443 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324646 - DNA, 2090 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagt

SEQ ID NO: 324647 - DNA, 1593 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttga

SEQ ID NO: 324648 - DNA, 2202 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagtaaaaaaaaaacaaaaaacaaaacaaatataaaaaaaactttgtggggggcttgggcccttagaaaagttttaaaaacaatcgtgggggggggggcccaagttggttatatga

SEQ ID NO: 324649 - DNA, 1816 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaaaaaaaaaaaaaaaaaaaaaaacaaaaaacgtgtgtgtgggcgcgcgcccgcgcggcccccgcgaagaagagctttcttagaaaccacattcgcgggggggcgcgcgcggggcccgcggggggtataggggaaaccgtgggcccaaagagtgggtgttccacagagggagaatccgcgggaacagggaacaaagggggcgggggatttctcccccacaaataaaaaaggcccgcggggggaaaaccagagggcgttctgtgcaaaaattctcaaagagggggttccggggggggccatagaggggggaccttattcaagggggagtcccagggagagccggaaatttaaaattggcccccaaaccggggggaga

SEQ ID NO: 324650 - DNA, 2138 bp, Homo sapiens
  misc_feature (1464)..(1464): n is a, c, g, or t
  misc_feature (1509)..(1509): n is a, c, g, or t
  misc_feature (1518)..(1518): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaaaaaaaaaaaaaaanaaaaaaaaaaaagaaaaaaaaaaaaaaaaaaaaaaaaaaaaaaanaaaaaaaanaaaaaaaaaagtttgggggggcggggccgaggagaattaaaaaaaccggtgggggggggcggagcgcgaaatataaagaaggaacaactatgcggcccgttgctcccagagaagaacctggaggcggaaagtaaaggaggcggggggcttgctgcccaaaaaaaaagaagcggcggcgggggggaaaggccagggcgtgtcacaaaccacaaaaagaggggcctgggagacggcaaaaggggcggcgtcaacaacgaagggggacagaaggggcggcataatatatactcccgccgcccgcggggggagacacaccagacaaaaacgaaagcaaagaggcaacagagaaacaacgtaatagaaagacacagaaagaaaaaaaacgaaaacaaaagacagcaaggagaacacacaagcaaatgaagcacaagcacacacaaacaacgggagaaagcgaaagacaaggaaaaaaaaaaaaacaaaaacaaaagacaaacgaacacagaaaaaagaagcagaagctcaaccacaacgaacaaagagaaaacaaagagaacgaggagagagcaagagaacggggataaacatgaaacaaacaaacaaaaagacaacggcaaata

SEQ ID NO: 324651 - DNA, 1459 bp, Homo sapiens
ggcccaccgggcgatgagcaaggtgggtcccagaggtgttcggcgatctcgtgccgaattcggcccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324652 - DNA, 1221 bp, Homo sapiens
  misc_feature (994)..(994): n is a, c, g, or t
  misc_feature (1003)..(1003): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcaaaaaaaaaaaagaaaaaaaaaaaaaaaaaaaaaaaaaaaaaaanaaaaaaaanaaaaaaaaaaaaaaaaaaaaaaaaaaaaaaaaaaagaaaaaaaagaaaaaaccaaaaagagcacaaaaacgacgcgacgcaaaaatagaacaaacaagaacgagcgacacacccatattaagcaaggaagaacaaagcagaatataagtagagacgagggccgacagtatcgaacgcaccctcaagaacagagctgagccaatagagaacacaatgcg

SEQ ID NO: 324653 - DNA, 1447 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324654 - DNA, 2094 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagt

SEQ ID NO: 324655 - DNA, 1899 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324656 - DNA, 2740 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagacaggtacttgagagaaagcttgttaagaggtattggtgtaatggagtagctagtaggagcaggtatttctcttaagtttgttggtgggttttaaactttggaagaatcggaggtttctgtgaaacatttgttgggtgtaatttggggtatgtgagttgtgctgagtgttggcttttgtctttaggtcactgttcatgttggtagtcagtaacttctatcttggatctgtcttctagttcatctttctagttgcatctttccaaatcttcccttatacttcagtttaggcctttttccatttcttggctccataatgacaaacattacattcaactctagctcttcacaaatttgtgttttctactattagcacaattgtaatatttatcaaacaggcagctgttttaatgttacaactggtaaagtagaaatcattctgagactaacttaagtcactgaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324657 - DNA, 1610 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324658 - DNA, 3291 bp, Homo sapiens
  misc_feature (2177)..(2177): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttgacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccntacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324659 - DNA, 3458 bp, Homo sapiens
  misc_feature (2177)..(2177): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttgacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccntacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324660 - DNA, 1420 bp, Homo sapiens
tggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324661 - DNA, 1393 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaagattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324662 - DNA, 1196 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaaaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324663 - DNA, 3831 bp, Homo sapiens
  misc_feature (2177)..(2177): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttgacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccntacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaaaaaaaaaaaaaaaaaaaaaaacaaaaaacgtgtgtgtgggcgcgcgcccgcgcggcccccgcgaagaagagctttcttagaaaccacattcgcgggggggcgcgcgcggggcccgcggggggtataggggaaaccgtgggcccaaagagtgggtgttccacagagggagaatccgcgggaacagggaacaaagggggcgggggatttctcccccacaaataaaaaaggcccgcggggggaaaaccagagggcgttctgtgcaaaaattctcaaagagggggttccggggggggccatagaggggggaccttattcaagggggagtcccagggagagccggaaatttaaaattggcccccaaaccggggggaga

SEQ ID NO: 324664 - DNA, 953 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgc

SEQ ID NO: 324665 - DNA, 1225 bp, Homo sapiens
  misc_feature (998)..(998): n is a, c, g, or t
  misc_feature (1007)..(1007): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcaaaaaaaaaaaagaaaaaaaaaaaaaaaaaaaaaaaaaaaaaaanaaaaaaaanaaaaaaaaaaaaaaaaaaaaaaaaaaaaaaaaaaagaaaaaaaagaaaaaaccaaaaagagcacaaaaacgacgcgacgcaaaaatagaacaaacaagaacgagcgacacacccatattaagcaaggaagaacaaagcagaatataagtagagacgagggccgacagtatcgaacgcaccctcaagaacagagctgagccaatagagaacacaatgcg

SEQ ID NO: 324666 - DNA, 895 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaacggcatcttcatcgaggaaaacggcatcttcatcggcgaaaacggcatcttcatcggcgaa

SEQ ID NO: 324667 - DNA, 1405 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgc

SEQ ID NO: 324668 - DNA, 1116 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtaggtaagatctttgataacttgtatttaagactttgcatacatagtatgctaaggcctgtcttctaagccataaattttttaccttaaagttctatttcgatatgtcactaaagtgtcaccaagttacagatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgc

SEQ ID NO: 324669 - DNA, 743 bp, Homo sapiens
acagagtcttgctccatcacccagactggagcacagtggcatacttcatggctcattgcagcctcgacctcccaggctcaagcaatcctcccacctcagcctccctagtggctggctaatttttgtatttttgatagagatggggtttcaccatgttgcccaggctggtctcaaactcctgagctcaagcgatctgcctgcctcggtctcccaaagtgctgggattacaggtgtgagccactgtactcagcccttaatctagttttttaattaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324670 - DNA, 408 bp, Homo sapiens
  misc_feature (346)..(346): n is a, c, g, or t
  misc_feature (365)..(365): n is a, c, g, or t
  misc_feature (375)..(375): n is a, c, g, or t
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaaccaccgcttgttttgtgattgagatccgagatcactgatcagccagagtgatgagacctatnggtgcggaaatggactgcnatgtagaganaatggcactcttgggcgcgctcaatatatgagg

SEQ ID NO: 324671 - DNA, 2778 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttgacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324672 - DNA, 2686 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaagattatcgtaggaggagtcctccacctcgtcgcagacaggtacttgagagaaagcttgttaagaggtattggtgtaatggagtagctagtaggagcaggtatttctcttaagtttgttggtgggttttaaactttggaagaatcggaggtttctgtgaaacatttgttgggtgtaatttggggtatgtgagttgtgctgagtgttggcttttgtctttaggtcactgttcatgttggtagtcagtaacttctatcttggatctgtcttctagttcatctttctagttgcatctttccaaatcttcccttatacttcagtttaggcctttttccatttcttggctccataatgacaaacattacattcaactctagctcttcacaaatttgtgttttctactattagcacaattgtaatatttatcaaacaggcagctgttttaatgttacaactggtaaagtagaaatcattctgagactaacttaagtcactgaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324673 - DNA, 1833 bp, Homo sapiens
gtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324674 - DNA, 1490 bp, Homo sapiens
aaagaggcgccgcgccagttttgtgacgttcagcacggggcggtggcgggggctcccggcccattcggagggtttcctagtcttggagtggaagaattaatattcctcattggggcatgagccaggatgggggttacctgggagttgggaaccacaaaggggagccgatagccgagttgtattcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagcaaacaattccacgttttgtttgacgacttccataaggcttggtgccattttcagatgtttttagctggtccaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaa

SEQ ID NO: 324675 - DNA, 2583 bp, Homo sapiens
tctattgcactttagtaaaacgaattgcttgtctagtccgtgtttaattggcacgagggccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccagcccgtcagtcagtctcacgctcggacatcccaggcccggagcactcagccacctccccactcctctgtcaaaaaagccagtactgacctgctggctgacatcggtggagacccctttgctgcaccccagatggcaccagcttttgctgcattccctgcctttgggggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctgctgaaggggtcccccattgttttgcttccccagcgcccaggatgagcggtttaccatcgagcttacccgggcccggctcctgtcaagcactttagttagctgttggtgtcatgtttggataccagtgttttatatttatacatagagaggattttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtcttttttttttttttttttctccatgtgcctccctgtccccaaatctctgcaccaaagctcattgcaggcaatgttggaaaagaactgcatttg

SEQ ID NO: 324676 - DNA, 2578 bp, Homo sapiens
ggacggcgaagtctcctgcggatgccgcccgctcccgagcttctgtcaggggagccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccagcccgtcagtcagtctcacgctcggacatcccaggcccggagcactcagccacctccccactcctctgtcaaaaaagccagtactgacctgctggctgacatcggtggagacccctttgctgcaccccagatggcaccagcttttgctgcattccctgcctttgggggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctgctgaaggggtcccccattgttttgcttccccagcgcccaggatgagcggtttaccatcgagcttacccgggcccggctcctgtcaagcactttagttagctgttggtgtcatgtttggataccagtgttttatatttatacatagagaggattttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtcttttttttttttttttttctccatgtgcctccctgtccccaaatctctgcaccaaagctcattgcaggcaatgttggaaaagaactgcatttg

SEQ ID NO: 324677 - DNA, 2378 bp, Homo sapiens
tctattgcactttagtaaaacgaattgcttgtctagtccgtgtttaattggcacgagggccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccagcccgtcagtcagtctcacgctcggacatcccaggcccggagcactcagccacctccccactcctctgtcaaaaaagccagtactgacctgctggctgacatcggtggagacccctttgctgcaccccagatggcaccagcttttgctgcattccctgcctttgggggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccaccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctgctgaaggggtcccccattgttttgcttccccagcgcccaggatgagcggtttaccatcgagcttacccgggcccggctcctgtcaagcactttagttagctgttggtgtcatgtttggataccagtgttttatatttatacatagagaggattttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtcttttttttttttttttttctccatgtgcctccctgtccccaaatctctgcaccaaagctcattgcaggcaatgttggaaaagaactgcatttg

SEQ ID NO: 324678 - DNA, 744 bp, Homo sapiens
ggacggcgaagtctcctgcggatgccgcccgctcccgagcttctgtcaggggagccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccaggtaactctcagatctgct

SEQ ID NO: 324679 - DNA, 482 bp, Homo sapiens
tctccatgtgcctccctgtccccaaatctctgcaccaaagctcattgcaggcaatgttggaaaagaactgcatttgaacgaaagagaaaacggcgcctgtggttttgcttcaggccactttgaggggttgcaggtcagtcaacatgactgatccttgacctggctctgctgggctggactgcctgggccagtgataatgctgccattggccagagacagggcagagcccgtccctgtctgaacaagagtcccgcattagcaatgagaagaagcgtggcgggagaggagccaccactgccggggactggagtttgttggatgtgaggggaatgcccactggggccagggtgggcaaaggaggttggtgccaatgtggtgctggaagtagacccctcctgggtctggaacattctctgccccaggctctttccacctggggatgttgtgacaacatccagctgtggtgtctgggctatttgtgt

SEQ ID NO: 324680 - DNA, 1328 bp, Homo sapiens
ggacggcgaagtctcctgcggatgccgcccgctcccgagcttctgtcaggggagccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggccagacaccttcccaaggaggctttgccaactttgatgcctttagcagtggccccagctcttctgtgtttggaagcctccctccagctggtcaagcctcgttccaggcccagccaactcctgcaggtaaactctgccccactggttcctttctcttccaaccgtgtccatttgtcatgtctataaatcaccattcatatcctcactatcctaaagaactgctcaaagcagcaaagcacaaagagaagcagctccaggagaggatgagcgtgtctgacacattcttgtcagggagagggggctctactgttctgctttttcatgaaaggaaaatgactaagattgcagcaggagctgtgtgggttatacactaggaaacttttcactaggaagtatggaagacctgagtcctagaaaaattgaaaatggacgtgactttttctctaaggtgctcttgtctgcatagtacgctgtcccaaagggtcaagggtcaaggtagtctccagaagtcctcatccatccctctaagaccaaaggcctgtaaactctatgttgctgccagccacaatggctcacgcctgcaatcctaacactttgggaggccgaggtgggaggatcgcttgagcccaggagtttgaggctgtagtgagtgattattgtgccattgcactccagtctgggtgacagagtgagaccccatctcaaaacaaacgaacgaacaaacaaaaccaaataaactatgttatttagccattg

SEQ ID NO: 324681 - DNA, 2110 bp, Homo sapiens
  misc_feature (2099)..(2099): n is a, c, g, or t
  misc_feature (2104)..(2104): n is a, c, g, or t
tctattgcactttagtaaaacgaattgcttgtctagtccgtgtttaattggcacgagggccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccagcccgtcagtcagtctcacgctcggacatcccaggcccggagcactcagccacctccccactcctctgtcaaaaaagccagtactgacctgctggctgacatcggtggagacccctttgctgcaccccagatggcaccagcttttgctgcattccctgcctttgggggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctctaccccctntaganccaaaa

SEQ ID NO: 324682 - DNA, 2222 bp, Homo sapiens
gcccgcccgcaggccagcttctctcgggagcctccacccaggcgcatggctccatgaagcaagaggaggaggcagagtcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatataacattaacagacaagacacttttcagaaagacaggcaacgtgttggaccttccggagcttctcagaagacagagggttttcttttgaggagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctgctgaaggggtcccccattgttttgcttccccagcgcccaggatgagcggtttaccatcgagcttacccgggcccggctcctgtcaagcactttagttagctgttggtgtcatgtttggataccagtgttttatatttatacatagagaggattttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtcttttttttttttttttttctccatgtgcctccctgtccccaaatctctgcaccaaagctcattgcaggcaatgttggaaaagaactgcatttg

SEQ ID NO: 324683 - DNA, 1623 bp, Homo sapiens
tctattgcactttagtaaaacgaattgcttgtctagtccgtgtttaattggcacgagggccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggacagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctgctgaaggggtcccccattgttttgcttccccagcgcccaggatgagcggtttaccatcgagcttacccgggcccggctcctgtcaagcactttagttagctgttggtgtcatgtttggataccagtgttttatatttatacatagagaggattttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtcttttttttttttttttttctccatgtgcctccctgtccccaaatctctgcaccaaagctcattgcaggcaatgttggaaaagaactgcatttg

SEQ ID NO: 324684 - DNA, 739 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattgcactcagaaggcaaaggaaccaccctacccatttggcctctggagggggcagaagaaagaaagaaacctcatcctatattttacaaagcatgtgaattctggaagacatgtccccgtggctgtggggccgctgcttctgtttaaataaaagtggcctggaa

SEQ ID NO: 324685 - DNA, 873 bp, Homo sapiens
  misc_feature (744)..(744): n is a, c, g, or t
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtncgaaaactcagacctgttctatgccgtgaaacctttacctagatcagccatcagcctgtcaactcagttaacaagttaaggaccgcagtgtttcaagtggatctcagtaaaggatcattggagccagaa

SEQ ID NO: 324686 - DNA, 3242 bp, Homo sapiens
  misc_feature (2)..(2): n is a, c, g, or t
tnaggctaggtacgaggccgggtggtaatcggccgacgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324687 - DNA, 3715 bp, Homo sapiens
  misc_feature (2)..(2): n is a, c, g, or t
tnaggctaggtacgaggccgggtggtaatcggccgaatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggcaggcagaggggttttcttgggggttttccccccccgggggggacccaaaatcggaccggtgccatggtcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324688 - DNA, 4118 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324689 - DNA, 4595 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaagaaaaaaaaaacaaacaactaactaaccacacaaacaccacaacaaccccaggcgcctatcggcggggggcgcgacaaacggttcacacagggcagggccaccactgggctcggccccccctgtgaccaggggcaaccgcggcccaggggcggaaaagcaagccggccgagcgaccggaacccgacgacgagagacgacgcggagaagcgagagcacacaggccagagaacgacggtcccatagcacatgagcagaactaaccgacagcgcagaccgagagcgaagaacctcacagcgcagccacgcagccgcg

SEQ ID NO: 324690 - DNA, 4468 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaaaaaaaaagaaatacattaaataaaaaaaaataatgattacttttcttatcacaaattagctttcttcattcaaatagaaactaaaatatatccaacgtataattttattcgaatgattttcaattaaaaaacaattaaaataatatcaatcttccgcttattcaaattctttactccattatttata

SEQ ID NO: 324691 - DNA, 4313 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaacaaaaaaaaaaaaaaaaaaaaaaaaaaaaaac

SEQ ID NO: 324692 - DNA, 4230 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatggctgcttctgtttaaataaagtggctgcaaaaaaaaaaaaaaaaaaaaaaaaaaaaaac

SEQ ID NO: 324693 - DNA, 4337 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggcggttatgtggagtgcatgttcttttcacagtaatatatgccttttgtaacttcacttggttattttattgtaaatgagtacaaaattcttaatttaagagattgtatgtaatatttatttcatgaatttctttccttgtttacgtaaattttgaaagattgcatgatttctgacagaaatcgatcttgatgctgtgaagtagtttgaggacatccta

SEQ ID NO: 324694 - DNA, 4231 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaaagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324695 - DNA, 2870 bp, Homo sapiens
  misc_feature (2)..(2): n is a, c, g, or t
tnaggctaggtacgaggccgggtggtaatcggccgaatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggataaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324696 - DNA, 1684 bp, Homo sapiens
  misc_feature (2)..(2): n is a, c, g, or t
tnaggctaggtacgaggccgggtggtaatcggccgagtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324697 - DNA, 4076 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccaggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324698 - DNA, 3522 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324699 - DNA, 955 bp, Homo sapiens
ccgacgactatgtctcggagttgtcagggtgtatcacccacttgccacgcatggacttgttgacactggcaggtttcttagacagaggtcctgtactggcaaacccctgtgcgaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324700 - DNA, 1580 bp, Homo sapiens
  misc_feature (2)..(2): n is a, c, g, or t
tnaggctaggtacgaggccgggtggtaatcggccgaatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgaggacctcgtctggctgatggaggcgatggcagggcaactccagcgtatccccttcgtcga

SEQ ID NO: 324701 - DNA, 629 bp, Homo sapiens
atttggcctctggagggggcagaagaaagacagaaacctcatcctatattttacaaaggtcttgtcattccaggtgccagaatcctctcagagtcattgaagggtgttcacccatcccacccaaggcttggcacactgccagtgtcttagcagggtcttgtgagggctgggggcatccaggtattttggaatcacaccctccggttatgttgctccaggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324702 - DNA, 1632 bp, Homo sapiens
  misc_feature (2)..(2): n is a, c, g, or t
tnaggctaggtacgaggccgggtggtaatcggccgaatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaaaagtggctggaaagaaaataacataaaatccgaggaaataaagacggggcggcgacaagagcgtatcggatgcgcaagggcaataggtggcctgacaagttcctggtccagcggaaattcgggccaaaggaggcgatatcgcaccggactaaaaaaacaaaaga

SEQ ID NO: 324703 - DNA, 1475 bp, Homo sapiens
  misc_feature (2)..(2): n is a, c, g, or t
tnaggctaggtacgaggccgggtggtaatcggccgaatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtattcatcagcagagaccagactcctccatcaagactcggctgatcccaccccacctgattcacctggcttcgttcttccatatcccctgccacaccccaccctcccgctgctcggccatccctgatcaggccaggctcgtttacccctcacggccaggctaaggatattccagcccagaatatcctccatctctccaggccacctttccaggtagacatgggcatttctgccccacacgcttatggcacctggctgagccctccttcatgtacctgatgctaaatcaatccttcctgtctgccccgtttgcctgagaccttctgtgttctgacccctagcaaatgtccactaaattcaattaaatcatcaac

SEQ ID NO: 324704 - DNA, 4281 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324705 - DNA, 834 bp, Homo sapiens
cttcctgcttctgccaccactgttgtgctggagtcctcactgcacctcacatgagttatctggagcttcagttctcccaagccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtattcatcagcagagaccagactcctccatcaagactcggctgatcccaccccacctgattcacctggcttcgttcttccatatcccctgccacaccccaccctcccgctgctcggccatccctgatcaggccaggctcgtttacccctcacggccaggctaaggatattccagcccagaatatcctccatctctccaggccacctttccaggtagacatgggcatttctgccccacacgcttatggcacctggctgagccctccttcatgtacctgatgctaaatcaatccttcctgtctgccccgtttgcctgagaccttctgtgttctgacccctagcaaatgtccactaaattcaattaaatcatcaac

SEQ ID NO: 324706 - DNA, 3671 bp, Homo sapiens
  misc_feature (2)..(2): n is a, c, g, or t
tnaggctaggtacgaggccgggtggtaatcggccgaatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324707 - DNA, 3030 bp, Homo sapiens
cttcctgcttctgccaccactgttgtgctggagtcctcactgcacctcacatgagttatctggagcttcagttctcccaagccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324708 - DNA, 4506 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaaaaacctactcctccacaaacacttcaggggtgcccccgcacccaattcgccctatagcgagcccattacaactcactgtccgtcttttcccaccttctgactggctaaacccttgcttcccccacttaattcccttgcgtacatctccctttcccagccgctctattacgaacaggcctctacccttggccttccacaacatggccaccctgaatggcacatgtc

SEQ ID NO: 324709 - DNA, 4227 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaacactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324710 - DNA, 4595 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaaaaaaaaaaaacaaaacaatataaaaacactaaaaacaaaaaatagaaaataacgctaaaaacaaatcttcacaaccttaagaactaaactaaaaaaaaaacctcgggggggggcccggtaccaaattccccctatagggagcccatttaacaatacttggccgtcttttaacaacgtcgtaactggaaaaaccttgcggttaccaaatttaatggctttggagcacaatccctttttcccaagtggataaaaacccaaaaaggccggaccgaacgcctttcccaacagttgcccaccccggaatggcaaaaggc

SEQ ID NO: 324711 - DNA, 2291 bp, Homo sapiens
ggcctggtaacccgagatccccggggaaaattacaccagggcaagtgtaaaaggtgagataagactcactcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324712 - DNA, 4227 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaacccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324713 - DNA, 4227 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccaggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324714 - DNA, 4186 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagccagcctctgtcgcccttagtcatataaccaaaatccagaccttatccacaacccggggcttggaaaggaaggtattttggaatcacaccctccggttatgttgctccaggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324715 - DNA, 3462 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatcttgccttctgagtgcctggatgcccccagccctcacaagaccctgctaagacactggcagtgtgccaagccttgggtgggatgggtgaacacccttcaatgactctgagcggattctggcacctggaatgacaagacgtcgagc

SEQ ID NO: 324716 - DNA, 1045 bp, Homo sapiens
  misc_feature (343)..(343): n is a, c, g, or t
tctcgtggattccatgtgtcttaatcctcgtcagcaggtcttagctaggtgtgcgacccgagtcgcagcgcaacggcttgtgccaagtagacagtgtgttaccagggtgttgtgagggctggggcgcttccaggcactcagatagtgctgaaggcacatgcagcctagcccatttgggtctctgtggagggggctcgtaccgaacagaaagtgataccgtacaatccgtgaatatctgtagccacacaagcccactgtgacacttcgtggcgattcagcgtctgcgagtatggaggacaccgagtgctgccgtgtcctctgtctccagctgtcttgcatgtgnagtgcatctctacttgcgtgctaggactccgaagtggcttacatccactcagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaa

SEQ ID NO: 324717 - DNA, 1522 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggtgaggcttgggtttctgtagccctggctcctccaggccagctgggcagggagcccggacagttaacactgtagccatactctctcccttcagggtaaagagtggctttgtcctaaggaactgcaatgccttcttaagcagcaacacagtcgtttccttctgaaggaaccaactaccttcagttcaagcagcaggctcttagcaagcatctgcttggtgctggggagtaagcccctgggccggtactttggggaacacagacctgttccgcccttgaggaagggttagcctctagccacggtgagcagacagatccctgcactgtaaagggccgcaggaacattagtaggaagtggctagttctgcctaggg

SEQ ID NO: 324718 - DNA, 3028 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaaggtacaataacctgaaagactctgagcagccagtcattcaaaaacattaataaagtgtttgttgtatcagagctttatactcagaaatagaaaaataaaataaaatacagctgctgtagtttgttcttacagaaactttagtaaggagaaagccacttacaaaaagtgtaactgaatcagctccaagaaattatgtgtgtaattgtgctttggagattagtgaaattgattgattaaagatgggtgagataatgaaagataacttcatggaagagatggatttctgagcaaggttttaaagttaggatttggtagagagatcttcaggttgagaatgatgagcatgagggttttcagtggtctagagcaggggtcggcaaatgttttctgtaaagggcctagtagtaaagttgtaggctttgtgcacaatatatagcctctgttgcagctattaactgtgctgttgtggtggggaagcagccacagatacataaacgaatgagcatggctgtgctccactaaaaactatttatggactctgaaatttaagtttcataaaattttcatgtgtcgaaaagttttattcttttatttcaaccatttaaaaataaaaaccgcaaggtatagtggctcacacctcatcccagcattatgggaggccaagacgggaggatcacttgagcctaggagtttgagaccagcctgggcaacatggtgagatcccatctctacaaaaaaaaaaaaaaaaaaagattagccaggcgtggtggtgtatgtctgcagtcctcgctactcagaagtctgaggtgagaggatggcttgggcttgaacccagaaggttgagcctgcagtgagccatgagcatgccactgcaacagaacgacaccctgtctcaaaaaaagtaaaaacctttaaaacatggtgttgggaaaactagatatccatgtccaaaagaagttggatcttaccttacaataaatacaaaaattaactcaaaatggatcaaagacctaaatgaactaaaactataagactcttagaaaaattataggacaaaaagcttcatgatactggatttgacagtgattactatttcttggatatgacaccaaaagcatacgcaagaaaagaaaaaatgagtaaattaaattatatcaaaatttaaaacttttgtgcaggacgttgtcaacacagtgaaaagggaagccacagaatgggagaaaatatttgcaaattatgtatctaataaggggttaatatccagaatatataaagaatttgtgcagttcaacaacaaaaaaactcccaaacaacctttttaaaaaatagacaaaggactcgctgggcgtggtggttcatgcctgtaatcccagcactttgagaggccaaggcaggtggatcacgaggtcaggagtccaagaccagcctgaccaataatggtgaaaccccgtctatactaaaaatacaaaaattagccaggcgtggtggtgtgtgcctgtattcccagctgctcgggaggctgagacacaagaattgcttgaacctggaaggcagaggttgtggtgagtcgagatcgtgccactgcactccagtctgggcaacagagaaagaccccatctcaaaaaaaaaaaaaaaagtaggaaag

SEQ ID NO: 324719 - DNA, 6474 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324720 - DNA, 6578 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaattttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324721 - DNA, 6526 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324722 - DNA, 5896 bp, Homo sapiens
ttaaagatcattttgctttttaatacagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324723 - DNA, 5731 bp, Homo sapiens
gctctaaaatgactgaagctttttaaagggttactgtttctcttggtctgtttttagaagagctgtgtactttggaatgtgatgggatacatttaaagaccctcaaatagatcagaacatatgtgatcttactttcttagtgtggtagattttgaaaccacacaggagaacaggtttatagataataaggactcaaaccatattggcctcagttcatttttgttaattgtgtcattggatgaatcgggagctcttacttccattttttagcttttcattttttggtattagtccagataaaaaggttggaacttcttctttgccagggagctcagagccaagttatactaatgattaagggacctaagacaggcaggagggagaaatacaaagtatagcgcttgggtggcatatgtggatatactctagaaaaggagtaaaacttggaaacgctaaaaaaaactgaagggtgaaagctgaatgagaatacctgaaaccaaaccgttaacaaggaatggtagtgaagttaaggagttagcacattctagcccccaggataaccagaatgatcagatgtctttctttatagtactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324724 - DNA, 5416 bp, Homo sapiens
gaccgtgtctcaaaaaaaacaaaaacaaacaaaaaccatagtgatctctcatgcttgcttacccttttatatacttctcagggagtgtttgactttttcccaaaaggtcagtaatctttttccagtgtcattgtattaatcttatcaattcttctcacttctttcagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324725 - DNA, 6653 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttgagccttctgaggggtcttgatgaccagatggacagtgagcccgtccttgattccgtggctggttcagtgtgtcccccatcagctgctgcgaagatcaggaccagctgatccttgctgagccttaaactccgggaagtttcctcctttgatagc

SEQ ID NO: 324726 - DNA, 5998 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgtt

SEQ ID NO: 324727 - DNA, 449 bp, Homo sapiens
ggactatagaaggagatattgtggtaataaacaaaaggtaactggatcgagtaagggaaagcagtatgtctcctttcccagaactctcttagtttcaagaactcattatctttctgggctcagaaaaggatatcccaaacaggaagtctggggaatggaggggagcagataatgtttgttctgtgattttaccattatatttctaaaaggctaccaattttttatgttttctgtactttctctttgtgctttattacagattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactagtaagtttggaaactcttaaactcaaggggaatat

SEQ ID NO: 324728 - DNA, 525 bp, Homo sapiens
gtaagtaggagagaaggggattagttgagcaaggggaggaaaaaagatacaggttcgtactgtatgcatcaggagcatacctacttggcctcactcattcactgttgagatgtgctggacctaattagaaaccttccgacctgaagtttatataaaactgggaaagctggtcactgcgaacagcgtatttgtatgtagtaagttgaatcccagggcactgtctttggagggcttattttttcactgagctaactatttttgttgtttcattttccataggactcacttggatagctcactcaaggtaacaaaaactcacctcacaatttaatttctggtttgcagtgtgtttactctgttattattattattattatcatattattgtttcaatttcctagttgaactgagatttctcctcttctctttgctcctcacccctttaggcatggccagactcgtgaccgagtgcatgaccggaacgtgaagaatatgtaccctcctccttccttccccactaacaaa

SEQ ID NO: 324729 - DNA, 6633 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324730 - DNA, 6460 bp, Homo sapiens
gagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324731 - DNA, 5106 bp, Homo sapiens
  misc_feature (55)..(55): n is a, c, g, or t
gcagaagattgtggttatcaagggtagcgatgagcccgcgtgttgtgtaatattntcagtgcgacagaggtcggtcgctcctcaacctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactg

SEQ ID NO: 324732 - DNA, 6629 bp, Homo sapiens
  misc_feature (301)..(301): n is a, c, g, or t
cggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacnggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgggggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttaaaaaatatataaacaaaacca

SEQ ID NO: 324733 - DNA, 2936 bp, Homo sapiens
gagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctaggtaaggcttcggaagaggagatggcagagccaggttgggatggtgggtggagaacagatgattatcacttggtcaccgtagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaaggtacaataacctgaaagactctgagcagccagtcattcaaaaacattaataaagtgtttgttgtatcagagctttatactcagaaatagaaaaataaaataaaatacagctgctgtagtttgttcttacagaaactttagtaaggagaaagccacttacaaaaagtgtaactgaatcagctccaagaaattatgtgtgtaattgtgctttggagattagtgaaattgattgattaaagatgggtgagataatgaaagataacttcatggaagagatggatttctgagcaaggttttaaagttaggatttggtagagagatcttcaggttgagaatgatgagcatgagggttttcagtggtctagagcaggggtcggcaaatgttttctgtaaagggcctagtagtaaagttgtaggctttgtgcacaatatatagcctctgttgcagctattaactgtgctgttgtggtggggaagcagccacagatacataaacgaatgagcatggctgtgctccactaaaaactatttatggactctgaaatttaagtttcataaaattttcatgtgtcgaaaagttttattcttttatttcaaccatttaaaaataaaaaccgcaaggtatagtggctcacacctcatcccagcattatgggaggccaagacgggaggatcacttgagcctaggagtttgagaccagcctgggcaacatggtgagatcccatctctacaaaaaaaaaaaaaaaaaaagattagccaggcgtggtggtgtatgtctgcagtcctcgctactcagaagtctgaggtgagaggatggcttgggcttgaacccagaaggttgagcctgcagtgagccatgagcatgccactgcaacagaacgacaccctgtctcaaaaaaagtaaaaacctttaaaacatggtgttgggaaaactagatatccatgtccaaaagaagttggatcttaccttacaataaatacaaaaattaactcaaaatggatcaaagacctaaatgaactaaaactataagactcttagaaaaattataggacaaaaagcttcatgatactggatttgacagtgattactatttcttggatatgacaccaaaagcatacgcaagaaaagaaaaaatgagtaaattaaattatatcaaaatttaaaacttttgtgcaggacgttgtcaacacagtgaaaagggaagccacagaatgggagaaaatatttgcaaattatgtatctaataaggggttaatatccagaatatataaagaatttgtgcagttcaacaacaaaaaaactcccaaacaacctttttaaaaaatagacaaaggactcgctgggcgtggtggttcatgcctgtaatcccagcactttgagaggccaaggcaggtggatcacgaggtcaggagtccaagaccagcctgaccaataatggtgaaaccccgtctatactaaaaatacaaaaattagccaggcgtggtggtgtgtgcctgtattcccagctgctcgggaggctgagacacaagaattgcttgaacctggaaggcagaggttgtggtgagtcgagatcgtgccactgcactccagtctgggcaacagagaaagaccccatctcaaaaaaaaaaaaaaaagtaggaaag

SEQ ID NO: 324734 - DNA, 526 bp, Homo sapiens
taatgtagaattacctgactggaatttccttcaactgttcttccttggtgatcctgatctgttggctaaatcaacatctctaagttcttaaaagccaaataaacatgacctattaatagataatttagaaatgaaaacaagccagttaaaactgaaagcataagtctagatgttgtacattattctgtaggtttatttataatgttttgctatccttacaaagagttagaaggattggaaaatgtgttgctgatttaaatatatttccctcttcctttatgtgttatctgagggcaggaagatgtactgaattagctcttgagcttaaatactatccttagaaagcttaacccacattgagtacctcctgtacattgaagcatcatggacattccatgatgcgtacatgaggaatacaaagatgttgcagtgtctgacatttaggggctcaagacttgtgtcagataaacactaaaccttgacatgtaggtacaaatcatattgctgctccttgaattaagtttat

SEQ ID NO: 324735 - DNA, 4438 bp, Homo sapiens
atggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctgcgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324736 - DNA, 4357 bp, Homo sapiens
ctccttcttctccccgccggcttgccggggatgcttgcgcgaggcgccccctcgcctttaagctcccggccccggggggcggtgtgtgtgagtagctgggagggggccgcgaggcgctccgccgagggctcgtccgggtttgtccgccgccgtcacctgactcgtcggaggagccacagctgagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324737 - DNA, 4073 bp, Homo sapiens
agcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatt

SEQ ID NO: 324738 - DNA, 4143 bp, Homo sapiens
agcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324739 - DNA, 3005 bp, Homo sapiens
gtctctggtgaaatatagattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324740 - DNA, 2867 bp, Homo sapiens
atggggacgcagctcggagcgctagagagacgcggcggcgctggcagaagaggcggcggcgggcggctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324741 - DNA, 1754 bp, Homo sapiens
agcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccgagtccgctgcattgggatcctctagacgaggga

SEQ ID NO: 324742 - DNA, 98 bp, Homo sapiens
actttgatttcagctttctactacttacctctgcttggttttggtttgtttcacttttggaagatgctttctcctctccaccacaaggggcctctcct

SEQ ID NO: 324743 - DNA, 550 bp, Homo sapiens
gttctggagagcgtgtattttaaaacccgtttgcttttccttaactgttaagattgtctacagtctttctgcctggagtgaaccatgaaatcccaagatgccatttgtcaaggctcatggttttcttttcccttgggtgacatgcactttttcctgtctgtgcttcactgcagtggatgcatttgcagcaccatctcctgcaaccactgcctcgccagcaaaggtggattcttcaggtgtcatagacctttttgggggtgcgtatttctcctccatcaacacttaaggaatctttttttcttcagaataatttttaaatctattttattatatttcatcattttttctttaggctatataaaattctgtctcttaaatgtaaacttaagtttttaagatcattttcatttcttcgtcatcatcatcttcatcctcatcatttcatcataactttcagtgcatgacctaacaaaacacataatttttcacttggtgttttcaactttttgttcttcatcctaatgtagaattacctgactggaatttcctt

SEQ ID NO: 324744 - DNA, 582 bp, Homo sapiens
  misc_feature (30)..(30): n is a, c, g, or t
tctagaggatcccaatgcagcggactcggnacagcacaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccgagtccgctgcattgggatcctctagacgaggga

SEQ ID NO: 324745 - DNA, 4246 bp, Homo sapiens
agcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324746 - DNA, 4134 bp, Homo sapiens
agcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaacaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324747 - DNA, 3074 bp, Homo sapiens
  misc_feature (30)..(30): n is a, c, g, or t
tctagaggatcccaatgcagcggactcggnacagcacaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324748 - DNA, 2866 bp, Homo sapiens
ctctttttattcttttaatttctgctgttttaaaaaccgcacccaagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccggttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagcgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaaaaataacg

SEQ ID NO: 324749 - DNA, 1074 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324750 - DNA, 835 bp, Homo sapiens
tatgggtagcgaggctgggtggccgtcccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcggtttgggcccaggaacaggcaaaaaaaaa

SEQ ID NO: 324751 - DNA, 1100 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggggcgcggtgagcgagcgggggcgcggtgtggggggaaggggagcggggacctggggacgcctaggtgccgggtgcgggcgcaggcggcctgacccttccgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324752 - DNA, 744 bp, Homo sapiens
aaaacatataggctaggtacgaggctggttgtaatcggccgaggaggactggggacgcctaggtgccgggtgcgggcgcaggcggcctgacccttccgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324753 - DNA, 1009 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324754 - DNA, 1176 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggggcgcggtgagcgagcgggggcgcggtgtggggggaaggggagcggggacctggggacgcctaggtgccgggtgcgggcgcaggcggcctgacccttccgcagggcctccgaggagctgctgcgtgagcactacgccgagctgcgtgaacgcccgttctacggccgccttgtcaagtatatggcctccgggccggtggtggccatggtgagtatccgggaagcgggcgggcggctccgggacccccacccccgcgtgataccgcgcccgttcctccgcacaggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324755 - DNA, 1102 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcggtttgggcccaggaacaggcaaaaaaaaa

SEQ ID NO: 324756 - DNA, 996 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324757 - DNA, 807 bp, Homo sapiens
tatgggtagcgaggctgggtggccgtcccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324758 - DNA, 1178 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggggcgcggtgagcgagcgggggcgcggtgtggggggaaggggagcggggacctggggacgcctaggtgccgggtgcgggcgcaggcggcctgacccttccgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324759 - DNA, 1254 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggggcgcggtgagcgagcgggggcgcggtgtggggggaaggggagcggggacctggggacgcctaggtgccgggtgcgggcgcaggcggcctgacccttccgcagggcctccgaggagctgctgcgtgagcactacgccgagctgcgtgaacgcccgttctacggccgccttgtcaagtatatggcctccgggccggtggtggccatggtgagtatccgggaagcgggcgggcggctccgggacccccacccccgcgtgataccgcgcccgttcctccgcacaggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgg

SEQ ID NO: 324760 - DNA, 1598 bp, Homo sapiens
gaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcagggcctccgaggagctgctgcgtgagcactacgccgagctgcgtgaacgcccgttctacggccgccttgtcaagtatatggcctccgggccggtggtggccatggtttggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcggaaaacaaaacaaaataaaaaaacaaaaaaaaaaaaaagacaacaaaaaacaaaataaaaaaaaaaaaaaaaaaagaacgagagagcggagagcgagaggagagagacacaccccgagcggccgacggagccccaccagatgtgcgctcaaatattgtggcgcccatagggggggcactgaaatgaggagcacgctaggacagagcgccggatgtcgacacacagcagaccaccaacgggcgaatcccgcgggcgaatgcgcgcgacaaacgcgcgccacgtggacgccaactcaacaccggcccgaggggagcccgacgacgccgacagcgtgtgggtgcgcccacatctagcgtggtgtaatatacacacgcagatggatgaccaagaagggcagtacacatgacgcgcgtatcaagctgggtacggacactcttgcatgcgcgaaagtgacaacaaaaccagcggctgaccatcgccgacacgggcggcgccggccaccctatcccccccccccgctactag

SEQ ID NO: 324761 - DNA, 4725 bp, Homo sapiens
  misc_feature (410)..(410): n is a, c, g, or t
  misc_feature (2094)..(2094): n is a, c, g, or t
  misc_feature (2200)..(2200): n is a, c, g, or t
  misc_feature (2582)..(2582): n is a, c, g, or t
  misc_feature (3527)..(3527): n is a, c, g, or t
  misc_feature (3553)..(3553): n is a, c, g, or t
ataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagngtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgtcggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaanacagatttttgccttaatttaaggaaaaacttgtcccttagaactgtctgacaaaaggaatggagaaatgggctgcctctggagtagcgagtgttccagcatggantggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactaccaaccctcagggaaccaggatactatagattcatagggttataagggaccttaaaggtcatttagtccagtcttgtagacttgattctctagggatatctggccacttttttagtgggnattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgtgagttatagtgttattgtctgataattttgcagtatttttaaatttttagttgactaatacaggtgatttatttgaaacatatctattttgtcatctttaataaaatgtctttattgtttttactgattttgaaggtaattcatgctcattgtttaaaatacaaacaatttgaaaatgtttaaaatagaaagtaaaagtattccaggcccacaggtaatataatcagttaaatttggttggcttttgcaaacttacaatacntacataaaattacatgtatgtatatnatgtgcatatgtttttaacatatctattatactatgcatactttttgtaactttttaaaaatttgatatagaatggacatttttctattgcagtacatacagatatgctaatgtttttaaacagctgtatagtatttatttaaccagtccttaatccctaattggtggggaattaggttttttgttgttgttgttacacagtgtgcatctttgtacatatgtatcagaggtgcttatttatgtatgtaagtaatcaaattcctaaaagcagcattgctggtcaaagggtatgcgttttaaactgatctatattgccagatttttctccagaaaaaggtttacagaattttcactcccagcaatgtgtgagaatgccagtttcttccctgaaacaggcttcttctcattatgtaatcagcattggttttttaaaatgtctgacaattttttttaaaataatttaactagctggtcttacatactagctcagttcttaaggtactaatcctaatgtaaacatgttctctacaaatgtaaatcttaacttgcgtgtcttctgtgtaaccaagaaaaagaagaaactagatcagagacaactatattgcaagagataattgacttacaagagttgatattggaattgctactttaactcagtgtaacttagagaagtttcgatgagacttaaaatccttggcctttttgctgagattctttggtaacccttggcttatttatatatgttttaaaagaatttattgtacctgtgagagtgaattaaatttctagagagtcataaaagttgaagctgagttaaataaaaagttaattgtattggcgaataattcaaaatgtgctttaagtataataggtttttaaaaatcatcttttttaaatgaacaggaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324762 - DNA, 322 bp, Homo sapiens
  misc_feature (42)..(43): n is a, c, g, or t
ggtatgtgtgcgataaggctgtattaattgtgacgctctgtnnggcccttcgggaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324763 - DNA, 1163 bp, Homo sapiens
gtacacctgtcaaacggtaacgcaggtgtcctaggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324764 - DNA, 3102 bp, Homo sapiens
cgggacccgtagggagaggcgggttgcgggcggcggcggcggcggcggcggcggtggtggttgtggcgaggctgtgcggcagggcgcacgggacctgtcctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgta

SEQ ID NO: 324765 - DNA, 1414 bp, Homo sapiens
taatatgtacttaagtttctccatgtcttcatggtttgatatttcttcttaccactgaataatattaattgtctggatgtaccacagttgtttatccattcacttaatgaagaacatcttggttgcttccaagtttcagcaattagaaataaagttgctgtaaacatctatatttaggttttcatgtggacattagttttcagctcatttgagtaaataccaagaagcatgattgttggagtatactagttactattctaagtgtttcatatgtattatctcatttaaacctctttaaacctctgtgagtaccaaggaagtaggtactcatatttctactttacatatatgaggaagctgaggcaaaaaagagattaatttgcccagtactatacaactgttaagtggtagagctaaaatgcaaatgtaaataatctgactccaaaggctgtacttttttgtactagaatatactacctctttactataccataacctctttttttcttgtcagtcttacagaacaggatatattatttgttaacttaggtatcttgtggcctggcacctataacttttaagctatcttaaagtagattgttcttaacagataaattggtgattgttcaatgtattttcttcaaatcctataagaagagaaaaatctgtcatgatgggaattacatttattttttaggttggtgaatgtcattgttggctccatgtttagatttctgtataatttaaatttacattggcataaatgtaatttttttattatcagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324766 - DNA, 2198 bp, Homo sapiens
cgggacccgtagggagaggcgggttgcgggcggcggcggcggcggcggcggcggtggtggttgtggcgaggctgtgcggcagggcgcacgggacctgtcctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacagtaagtgctgatattaatagagaatatgtaccttttcaatcagtttaggaagctataaccacagctttattaatggaaaaatacaacatcatggtgatctatttaatgccaaggactgcctagcctggtaagattagagcttattcccagccattgtcataagcagccaacacatccagcttcctcctggtaaataaatctttcatcagttcactttaacagatgaacctctggtccttgcttggatttcttcagagatggctgtttcctaagcttccagagaagcctattccatcatactgtgattatcataaacctatgcaagggaatcccttgcatgggaagtacacttctatactgctatcccactggtcttttaaaaagtaaaataataatatttactgttacaaatacataatatatttactatgctcagtgtagtaaaaaaactacagcctaaggagatttacccaattccccttagttattccccaatataacttaggcttacatttttccttaaaaatagtttcttttttattcacttcttgagcagactataatttaaaatgagaatgaacagagaagttataaagtaagcccacaaagtaaagagaagcaatgacatttcacaagtatttcaaagcaaaattttaggtaatacatttagggagaggtgccaccatatgaaatatttttattttaatcaatctgggtatagttatgattattctagaaactaagaattatttgatggctgaatcatggcgatatattgatatatagcagaatcagccaatatgttgacttaaagtattttatttttattaatctcatataatgtatcatgtagtaatttttttactctattgatcttaagtatgcttttttttttaaatagggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324767 - DNA, 688 bp, Homo sapiens
ggttaatttgcatattttagaagtacattttaggggtaatactagatcatatagataaatattatcaccaactaccatagctaatattcctttcctttctgcaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324768 - DNA, 6530 bp, Homo sapiens
  misc_feature (410)..(410): n is a, c, g, or t
  misc_feature (2094)..(2094): n is a, c, g, or t
  misc_feature (2200)..(2200): n is a, c, g, or t
  misc_feature (2582)..(2582): n is a, c, g, or t
  misc_feature (3527)..(3527): n is a, c, g, or t
  misc_feature (3553)..(3553): n is a, c, g, or t
ataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagngtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgtcggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaanacagatttttgccttaatttaaggaaaaacttgtcccttagaactgtctgacaaaaggaatggagaaatgggctgcctctggagtagcgagtgttccagcatggantggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactaccaaccctcagggaaccaggatactatagattcatagggttataagggaccttaaaggtcatttagtccagtcttgtagacttgattctctagggatatctggccacttttttagtgggnattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgtgagttatagtgttattgtctgataattttgcagtatttttaaatttttagttgactaatacaggtgatttatttgaaacatatctattttgtcatctttaataaaatgtctttattgtttttactgattttgaaggtaattcatgctcattgtttaaaatacaaacaatttgaaaatgtttaaaatagaaagtaaaagtattccaggcccacaggtaatataatcagttaaatttggttggcttttgcaaacttacaatacntacataaaattacatgtatgtatatnatgtgcatatgtttttaacatatctattatactatgcatactttttgtaactttttaaaaatttgatatagaatggacatttttctattgcagtacatacagatatgctaatgtttttaaacagctgtatagtatttatttaaccagtccttaatccctaattggtggggaattaggttttttgttgttgttgttacacagtgtgcatctttgtacatatgtatcagaggtgcttatttatgtatgtaagtaatcaaattcctaaaagcagcattgctggtcaaagggtatgcgttttaaactgatctatattgccagatttttctccagaaaaaggtttacagaattttcactcccagcaatgtgtgagaatgccagtttcttccctgaaacaggcttcttctcattatgtaatcagcattggttttttaaaatgtctgacaattttttttaaaataatttaactagctggtcttacatactagctcagttcttaaggtactaatcctaatgtaaacatgttctctacaaatgtaaatcttaacttgcgtgtcttctgtgtaaccaagaaaaagaagaaactagatcagagacaactatattgcaagagataattgacttacaagagttgatattggaattgctactttaactcagtgtaacttagagaagtttcgatgagacttaaaatccttggcctttttgctgagattctttggtaacccttggcttatttatatatgttttaaaagaatttattgtacctgtgagagtgaattaaatttctagagagtcataaaagttgaagctgagttaaataaaaagttaattgtattggcgaataattcaaaatgtgctttaagtataataggtttttaaaaatcatcttttttaaatgaacaggaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgta

SEQ ID NO: 324769 - DNA, 5337 bp, Homo sapiens
  misc_feature (410)..(410): n is a, c, g, or t
  misc_feature (2094)..(2094): n is a, c, g, or t
  misc_feature (2200)..(2200): n is a, c, g, or t
  misc_feature (2582)..(2582): n is a, c, g, or t
ataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagngtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgtcggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaanacagatttttgccttaatttaaggaaaaacttgtcccttagaactgtctgacaaaaggaatggagaaatgggctgcctctggagtagcgagtgttccagcatggantggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactaccaaccctcagggaaccaggatactatagattcatagggttataagggaccttaaaggtcatttagtccagtcttgtagacttgattctctagggatatctggccacttttttagtgggnattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgta

SEQ ID NO: 324770 - DNA, 3532 bp, Homo sapiens
  misc_feature (410)..(410): n is a, c, g, or t
  misc_feature (2094)..(2094): n is a, c, g, or t
  misc_feature (2200)..(2200): n is a, c, g, or t
  misc_feature (2582)..(2582): n is a, c, g, or t
ataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagngtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgtcggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaanacagatttttgccttaatttaaggaaaaacttgtcccttagaactgtctgacaaaaggaatggagaaatgggctgcctctggagtagcgagtgttccagcatggantggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactaccaaccctcagggaaccaggatactatagattcatagggttataagggaccttaaaggtcatttagtccagtcttgtagacttgattctctagggatatctggccacttttttagtgggnattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324771 - DNA, 2129 bp, Homo sapiens
  misc_feature (66)..(66): n is a, c, g, or t
  misc_feature (77)..(77): n is a, c, g, or t
aatctaaaccgtattaatatttctatgcgtatagcccccacaaacaaggctgaggagtctactgangaggaagctgncgggtcaaaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgta

SEQ ID NO: 324772 - DNA, 3860 bp, Homo sapiens
  misc_feature (410)..(410): n is a, c, g, or t
  misc_feature (2094)..(2094): n is a, c, g, or t
  misc_feature (2200)..(2200): n is a, c, g, or t
  misc_feature (2582)..(2582): n is a, c, g, or t
  misc_feature (3699)..(3699): n is a, c, g, or t
  misc_feature (3713)..(3713): n is a, c, g, or t
  misc_feature (3763)..(3763): n is a, c, g, or t
  misc_feature (3809)..(3809): n is a, c, g, or t
ataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagngtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgtcggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaanacagatttttgccttaatttaaggaaaaacttgtcccttagaactgtctgacaaaaggaatggagaaatgggctgcctctggagtagcgagtgttccagcatggantggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactaccaaccctcagggaaccaggatactatagattcatagggttataagggaccttaaaggtcatttagtccagtcttgtagacttgattctctagggatatctggccacttttttagtgggnattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgtaattcatgctcattgtttaaaatacaaacaatttgaaaatgtttaaaatagaaagtaaaagtattccaggcccacaggaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaaaaaaaaaaaaaaaaaaaaaaaaaaaaaaaaaaaaacaaaaaaaaaaaaaaaaaaaaaaaaaaaaaaaaaaaaaaaaaaaaaaaccccnaaaaccaaccccancacacaataccacccccaccccaccacaccccactacacgcccacaatcncaatacccccccccaacaaaacaccacacccacaaaccaccaaaancccaaaccccatctcctatttctcctctttctatcagcctctttcatttcc

SEQ ID NO: 324773 - DNA, 1297 bp, Homo sapiens
cgggacccgtagggagaggcgggttgcgggcggcggcggcggcggcggcggcggtggtggttgtggcgaggctgtgcggcagggcgcacgggacctgtcctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaa

SEQ ID NO: 324774 - DNA, 4003 bp, Homo sapiens
cgggacccgtagggagaggcgggttgcgggcggcggcggcggcggcggcggcggtggtggttgtggcgaggctgtgcggcagggcgcacgggacctgtcctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacagtaagtgctgatattaatagagaatatgtaccttttcaatcagtttaggaagctataaccacagctttattaatggaaaaatacaacatcatggtgatctatttaatgccaaggactgcctagcctggtaagattagagcttattcccagccattgtcataagcagccaacacatccagcttcctcctggtaaataaatctttcatcagttcactttaacagatgaacctctggtccttgcttggatttcttcagagatggctgtttcctaagcttccagagaagcctattccatcatactgtgattatcataaacctatgcaagggaatcccttgcatgggaagtacacttctatactgctatcccactggtcttttaaaaagtaaaataataatatttactgttacaaatacataatatatttactatgctcagtgtagtaaaaaaactacagcctaaggagatttacccaattccccttagttattccccaatataacttaggcttacatttttccttaaaaatagtttcttttttattcacttcttgagcagactataatttaaaatgagaatgaacagagaagttataaagtaagcccacaaagtaaagagaagcaatgacatttcacaagtatttcaaagcaaaattttaggtaatacatttagggagaggtgccaccatatgaaatatttttattttaatcaatctgggtatagttatgattattctagaaactaagaattatttgatggctgaatcatggcgatatattgatatatagcagaatcagccaatatgttgacttaaagtattttatttttattaatctcatataatgtatcatgtagtaatttttttactctattgatcttaagtatgcttttttttttaaatagggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgta

SEQ ID NO: 324775 - DNA, 7431 bp, Homo sapiens
  misc_feature (410)..(410): n is a, c, g, or t
  misc_feature (2094)..(2094): n is a, c, g, or t
  misc_feature (2200)..(2200): n is a, c, g, or t
  misc_feature (2582)..(2582): n is a, c, g, or t
  misc_feature (3527)..(3527): n is a, c, g, or t
  misc_feature (3553)..(3553): n is a, c, g, or t
ataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagngtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgtcggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaanacagatttttgccttaatttaaggaaaaacttgtcccttagaactgtctgacaaaaggaatggagaaatgggctgcctctggagtagcgagtgttccagcatggantggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactaccaaccctcagggaaccaggatactatagattcatagggttataagggaccttaaaggtcatttagtccagtcttgtagacttgattctctagggatatctggccacttttttagtgggnattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgtgagttatagtgttattgtctgataattttgcagtatttttaaatttttagttgactaatacaggtgatttatttgaaacatatctattttgtcatctttaataaaatgtctttattgtttttactgattttgaaggtaattcatgctcattgtttaaaatacaaacaatttgaaaatgtttaaaatagaaagtaaaagtattccaggcccacaggtaatataatcagttaaatttggttggcttttgcaaacttacaatacntacataaaattacatgtatgtatatnatgtgcatatgtttttaacatatctattatactatgcatactttttgtaactttttaaaaatttgatatagaatggacatttttctattgcagtacatacagatatgctaatgtttttaaacagctgtatagtatttatttaaccagtccttaatccctaattggtggggaattaggttttttgttgttgttgttacacagtgtgcatctttgtacatatgtatcagaggtgcttatttatgtatgtaagtaatcaaattcctaaaagcagcattgctggtcaaagggtatgcgttttaaactgatctatattgccagatttttctccagaaaaaggtttacagaattttcactcccagcaatgtgtgagaatgccagtttcttccctgaaacaggcttcttctcattatgtaatcagcattggttttttaaaatgtctgacaattttttttaaaataatttaactagctggtcttacatactagctcagttcttaaggtactaatcctaatgtaaacatgttctctacaaatgtaaatcttaacttgcgtgtcttctgtgtaaccaagaaaaagaagaaactagatcagagacaactatattgcaagagataattgacttacaagagttgatattggaattgctactttaactcagtgtaacttagagaagtttcgatgagacttaaaatccttggcctttttgctgagattctttggtaacccttggcttatttatatatgttttaaaagaatttattgtacctgtgagagtgaattaaatttctagagagtcataaaagttgaagctgagttaaataaaaagttaattgtattggcgaataattcaaaatgtgctttaagtataataggtttttaaaaatcatcttttttaaatgaacaggaaactctgatgaggaagaaagtgcttcagaatctgaactttggaagggtccactaccagagacagatgaaaaatcacagtaagtgctgatattaatagagaatatgtaccttttcaatcagtttaggaagctataaccacagctttattaatggaaaaatacaacatcatggtgatctatttaatgccaaggactgcctagcctggtaagattagagcttattcccagccattgtcataagcagccaacacatccagcttcctcctggtaaataaatctttcatcagttcactttaacagatgaacctctggtccttgcttggatttcttcagagatggctgtttcctaagcttccagagaagcctattccatcatactgtgattatcataaacctatgcaagggaatcccttgcatgggaagtacacttctatactgctatcccactggtcttttaaaaagtaaaataataatatttactgttacaaatacataatatatttactatgctcagtgtagtaaaaaaactacagcctaaggagatttacccaattccccttagttattccccaatataacttaggcttacatttttccttaaaaatagtttcttttttattcacttcttgagcagactataatttaaaatgagaatgaacagagaagttataaagtaagcccacaaagtaaagagaagcaatgacatttcacaagtatttcaaagcaaaattttaggtaatacatttagggagaggtgccaccatatgaaatatttttattttaatcaatctgggtatagttatgattattctagaaactaagaattatttgatggctgaatcatggcgatatattgatatatagcagaatcagccaatatgttgacttaaagtattttatttttattaatctcatataatgtatcatgtagtaatttttttactctattgatcttaagtatgcttttttttttaaatagggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgta

SEQ ID NO: 324776 - DNA, 449 bp, Homo sapiens
ctggtacactaaggtaagaacccaggagagagaaagccctctgtccttgtgataagtcagagagtctaactgagctgattaatgcaagccacctgcagacggctaaactgaaagagtgcactgtaacacacgtccactggggcttccagagctgtaaacactcaaccctagatgctgctgtggagtcagtgctctccacgacctgcccttctgcatgctcccctaagggtatgagcagtagggcaccaaagaagcgagccacacccccatcacatgtcctgcaatggggataagggaacttttcccatttcaatagtgagtgagttctcacagatctgattgttttataagcacctggcatttcccctgcttgcactcactgcatcctgctgccctgtgaagaaggcacctgcttctcctttgccttccaccatgattttaagtttcct

SEQ ID NO: 324777 - DNA, 2542 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgtagaa

SEQ ID NO: 324778 - DNA, 2525 bp, Homo sapiens
  misc_feature (1362)..(1362): n is a, c, g, or t
  misc_feature (1402)..(1402): n is a, c, g, or t
  misc_feature (1404)..(1404): n is a, c, g, or t
  misc_feature (1817)..(1817): n is a, c, g, or t
  misc_feature (1860)..(1860): n is a, c, g, or t
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggtgagtgccgcgcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcagggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcctctccctcccctcccaacttcggtttcctcaggactctgcccacttccaccagagacacattgagaaggaggaaactatggcctccaggcttccgacggcctggtcctgtgtgagtagaggcttccttcagcttttgagtccgctactgcacctgggaggatgcggatggtggtgagataccaccttccctgagatacccccatcctccagagcacctcggggagggggtagagattggttgggcatgagagatcctgcgtgatggtggaaccgcaggttgcttggttttccaagggtgtagttagaatagagaccagattgtaggggcttctgaaggccaggttaaggctcttgcttgtatcctttatattgggaagagtaattgacaggtcttttgtttgtttgttttttgttttttgagatggagtctccctctgtcgcccaggctggagtgcagtggcgcgatcttggctcactgcaacctccgcctcctgggttcangtgattctcctgcctcagcctccccgagtagctgggactncnggcgtgtgccaccatacccagctaattttttttatttttattttttgtgtgtgttttttgtggagacggggtttcaccatgttggccaggctggtctggaactcttgacctaaggtgatccgaccatctcggcctcccaaaggtctatgcagggatcaggcttatgtttagatttcagcagataaattggcatcaagcaagaggtgacagcagcagagttcaataacaagtagaaaagacaggtgaggatggatccctgacaggtgaaggagatagaaagaagcatcagggccctgggtaggggctgacggcttgggtgtgatggtgcagctcagagaattccctaggaggcatacgcaccactcccaaagtcagaattttcaaatgaataagaaatagggggccgggcgcgnttttcatatgctacagagatctcatgtgttgctctccttattntaacctgaatagagtcaagcttgggtttgcttggggtttcagacaaagacaggaactcaggatgagactcccaaaatgcccttgggtcatcttgtagaccattctgtgctttcactggcctggtcagcctcccctgtctttcttttgtcgtggatgcggatggcctgtggctgaacaagaatctggatttttaggaaccagtgacctttgaagatgtaacactgggttttaccccggaagagtggggactgctggacctcaaacagaagtccctgtacagggaagtgatgctggagaactacaggaacctggtctcagtgggtaaggctggcctccaggtcaagaaggatctgtgctttgtagcacaaatgtagcacctctgaagtatgtgtctgcttgggctcagactgcaggggcaccagtaggaaaagggcagcttttcagtatgacttctgaatcattgcctagtccatccctccctgaataccagggagatgggtctgtcagggatgttttcagctgcagtagtggatgcttattgttcttgcaacaagagttccggccaggcatggtggctcactttaggagactgaagcaggaggattgcttgagcccaggagtttgagaccagcatgggcaacatagaccgtgtctctattaaaaaa

SEQ ID NO: 324779 - DNA, 4405 bp, Homo sapiens
  misc_feature (1362)..(1362): n is a, c, g, or t
  misc_feature (1402)..(1402): n is a, c, g, or t
  misc_feature (1404)..(1404): n is a, c, g, or t
  misc_feature (1817)..(1817): n is a, c, g, or t
  misc_feature (1860)..(1860): n is a, c, g, or t
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggtgagtgccgcgcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcagggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcctctccctcccctcccaacttcggtttcctcaggactctgcccacttccaccagagacacattgagaaggaggaaactatggcctccaggcttccgacggcctggtcctgtgtgagtagaggcttccttcagcttttgagtccgctactgcacctgggaggatgcggatggtggtgagataccaccttccctgagatacccccatcctccagagcacctcggggagggggtagagattggttgggcatgagagatcctgcgtgatggtggaaccgcaggttgcttggttttccaagggtgtagttagaatagagaccagattgtaggggcttctgaaggccaggttaaggctcttgcttgtatcctttatattgggaagagtaattgacaggtcttttgtttgtttgttttttgttttttgagatggagtctccctctgtcgcccaggctggagtgcagtggcgcgatcttggctcactgcaacctccgcctcctgggttcangtgattctcctgcctcagcctccccgagtagctgggactncnggcgtgtgccaccatacccagctaattttttttatttttattttttgtgtgtgttttttgtggagacggggtttcaccatgttggccaggctggtctggaactcttgacctaaggtgatccgaccatctcggcctcccaaaggtctatgcagggatcaggcttatgtttagatttcagcagataaattggcatcaagcaagaggtgacagcagcagagttcaataacaagtagaaaagacaggtgaggatggatccctgacaggtgaaggagatagaaagaagcatcagggccctgggtaggggctgacggcttgggtgtgatggtgcagctcagagaattccctaggaggcatacgcaccactcccaaagtcagaattttcaaatgaataagaaatagggggccgggcgcgnttttcatatgctacagagatctcatgtgttgctctccttattntaacctgaatagagtcaagcttgggtttgcttggggtttcagacaaagacaggaactcaggatgagactcccaaaatgcccttgggtcatcttgtagaccattctgtgctttcactggcctggtcagcctcccctgtctttcttttgtcgtggatgcggatggcctgtggctgaacaagaatctggatttttaggaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgtagaa

SEQ ID NO: 324780 - DNA, 1570 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactccactgaaacacatctgtagaccactaagtttatccttgtcacccagtttgctcttggaaagagtctgttcccttttgtcactgaaccaatcatgacataaacttgtgctttacctcctat

SEQ ID NO: 324781 - DNA, 2097 bp, Homo sapiens
  misc_feature (1362)..(1362): n is a, c, g, or t
  misc_feature (1402)..(1402): n is a, c, g, or t
  misc_feature (1404)..(1404): n is a, c, g, or t
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggtgagtgccgcgcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcagggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcctctccctcccctcccaacttcggtttcctcaggactctgcccacttccaccagagacacattgagaaggaggaaactatggcctccaggcttccgacggcctggtcctgtgtgagtagaggcttccttcagcttttgagtccgctactgcacctgggaggatgcggatggtggtgagataccaccttccctgagatacccccatcctccagagcacctcggggagggggtagagattggttgggcatgagagatcctgcgtgatggtggaaccgcaggttgcttggttttccaagggtgtagttagaatagagaccagattgtaggggcttctgaaggccaggttaaggctcttgcttgtatcctttatattgggaagagtaattgacaggtcttttgtttgtttgttttttgttttttgagatggagtctccctctgtcgcccaggctggagtgcagtggcgcgatcttggctcactgcaacctccgcctcctgggttcangtgattctcctgcctcagcctccccgagtagctgggactncnggcgtgtgccaccatacccagctaattttttttatttttattttttgtgtgtgttttttgtggagacggggtttcaccatgttggccaggctggtctggaactcttgacctaaggtgatccgaccatctcggcctcccaaaggtctatgcagggatcaggcttatgtttagatttcagcagataaattggcatcaagcaagaggtgacagcagcagagttcaataacaagtagaaaagacaggtgaggatggatccctgacaggtgaaggagatagaaagaagcatcagggccctgggtaggggctgacggcttgggtgtgatggtgcagctcagagaattccctaggaggcatacgcaccactcccaaagtcagaattttcaaatgaataagaaatagggggccgggcgcggtggctcacgtctgtaatcccagcactttgggaggccgaggcaggtggatcacgaggtcaggagattgagaccatcctggctaacatagtgaaaccccgtctctacttaaaaaaatacaaaaaattagccgggcgtggtggcgggcgcctgtagtcccagctactcgggaggctgaggcaggagaatggcgtgaaccggggaggcggagcttgcagtgagccgagatggcgccactgcactccagcctgggcgacagagagagactccgtctcaaaaaaaa

SEQ ID NO: 324782 - DNA, 408 bp, Homo sapiens
gctgcctcgaggtcactgcccagcaggaggagaagcaggaggatgcagccatctgcccagtgacagtgctccctgaggtaagcggggagtatcaccctgttttggtcacagcatctcctgtgaggcaggcccacccctgaggcatccactctgccctgggctttcctaagacctcccacaggctgggacattctgagattctgagctcttaggtctgtgctgaagcaatctgagtatgaagagcagccctgccctccagccactgtggcatcactggagacaacgcatggtgacccgggagctgagaaagcaggaggcaagagggaagggactaagtgtttacagagacttgagaggtggaactaccacaggcaggcacatctgtatccaggtcagaacaagagagcc

SEQ ID NO: 324783 - DNA, 2747 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgtagaa

SEQ ID NO: 324784 - DNA, 2843 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgtagaa

SEQ ID NO: 324785 - DNA, 2317 bp, Homo sapiens
agaggttctgacagagctcacagtgctagggtctctcctgctttggggatttgctcagagacaccaacccaggcccacaagagttctactgggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgtagaa

SEQ ID NO: 324786 - DNA, 671 bp, Homo sapiens
gcatggtggtgcgcacctgtaatcccaactacttgggaggctgaggaaggagaatcacttgaacccaggaggtggaggttgcagtaagctgagaccgagccactgcacgccagcctaggcaacaagaacaataacaacaacaaaaacaatagaaatttattctcttacaactctggaggctggaagttggaaatcaatgtgtcaacagggctgtgttcctcctgagattccagtagaatcctttcttgactcttctagcttctgctggtggctctcagtccttggcattttttggtttgcagctgcatggctccactctgtctctgtcattacatggccttccccttgtatgtctctaccttcatgtctctaccttcacatcatcttatgaacacacttgtcatattagattagagcccaccctaatgtcttcttcttagctctattatatctgcaaagtccctatttccaaaaaaaaaaccacattcacaggtatggagttaggacttaaaacgtatgtttttgggaggacacaatttaacccatagctataataaggggggttgaataaagattgctttctatagattgcaaagaattaataaaatatttcgatcatggtttctgttgcttttcagttaggagacatgacccacagggaatgtgatggc

SEQ ID NO: 324787 - DNA, 456 bp, Homo sapiens
ggagtgcacaggctccatgccagacgcttccagaatcggcagagctggcctctggggaagaggagccaggggttcctcctgcaaaattaaaaaggttccaaaagtctttgtaattagaaaggacaaccatgaggacactggaggtcttcctgcccagtgtgggctgagccagccccggcagtgagcctcagagccccaggcctcctctgtctggcttccagggccccacacaggttgtcattggggagagactgttctgctgagagcccctcacccaggtttttgcctggtagccccagcccttcccctactctctgtgggctctgggaccccagttctccgtccctggttctcatcctcactccctcgcctacccagttaggaccccacggtggggcttcagcagccccagaccccatccttggtgcctggctgtgccctgggccctccaagcca

SEQ ID NO: 324788 - DNA, 285 bp, Homo sapiens
agcccgttttaagtcaagtttctttgatagttttctccttcagtgatctgtttggtgttttctctgggatgtcgaagtttcccactattattgtatggctttttattttattttcttaggtgtagtagtacttttataaatctgggtgctctggtgttgggtaatgtatatatttaggatagttaaatcttcttattgagttgaagtctttatcatgtatcatacccttctttgtctttttttactcttgttggtttaaagtctattttatctgacataagaata

SEQ ID NO: 324789 - DNA, 3660 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324790 - DNA, 3695 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggtgagacacctgacgtctgccccgcgctgccggcggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324791 - DNA, 3691 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324792 - DNA, 3700 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgccggccgggtcggtggggcggtcggctgcccgcgcggcctctcagttgggaaagctgaggttgtcgccggggccgcgggtggaggtcggggatgaggcagcaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324793 - DNA, 2810 bp, Homo sapiens
  misc_feature (26)..(26): n is a, c, g, or t
accctcgtctggtccccccgcgttantggctatcgtcgacccaggccctcgccttcggggtgaggcgtgcgccggctgactggactggcgcggtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324794 - DNA, 1583 bp, Homo sapiens
  misc_feature (45)..(45): n is a, c, g, or t
ggtctagtcaggcctgtgtgatcggccgaggggactcctgggagnagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324795 - DNA, 1358 bp, Homo sapiens
gacctgagtcctccaagtcctccggcaccttgagctccagagagcagaattcagcctcttcctgtgcctccccagggtgggcatatgagccagccccatcccattcatcacccgtatgcctgtgtgcccatcccccttgcaggttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324796 - DNA, 1102 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324797 - DNA, 906 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgccggccgggtcggtggggcggtcggctgcccgcgcggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggcacgcattatgtataagatcctctag

SEQ ID NO: 324798 - DNA, 3845 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgccggccgggtcggtggggcggtcggctgcccgcgcggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324799 - DNA, 3580 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324800 - DNA, 3491 bp, Homo sapiens
aattatggctaggtagaggcctgcggtgtaatcaggcagagggaggccggagcggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324801 - DNA, 3621 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324802 - DNA, 2396 bp, Homo sapiens
  misc_feature (21)..(21): n is a, c, g, or t
aagctagtaagctcggttcanttcggacgaggcaagagcgtgtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaa

SEQ ID NO: 324803 - DNA, 3801 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgctgcccggctgcccagagggctggatgcctgccggtccccgagcaagcctgggaactcaggaaaattcacaggacttgggagattctaaatcttaagtgcaattatttttaataaaaggggcatttggaaaaaaaaaaaataatataaacacaaatattagaaataaatctatatgagtgccaacttcctatttattagtttacttactaaaaatccttgggggggacccgggtccaatattacccctatgtgagagcgttttatctcgcc

SEQ ID NO: 324804 - DNA, 3143 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctattcacaggacttgggagattctaaatcttaagtgcaattatttttaataaaaggggcatttggaa

SEQ ID NO: 324805 - DNA, 457 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactcctcgacctggtgatgatcgaagtgcagagcggcgaatacctgggcgaagacgacattgtgcgcttcgatgacatctacgccgtgcgcccgccgacgtgaaaaaatgacatgctgtacctcactgatcatcccgacccgtaacgccgtgagatcagcatgtcc

SEQ ID NO: 324806 - DNA, 4320 bp, Homo sapiens
gaatctgtgaccagcttgggaagctcctgcagggaggaaggaatgatccacaagtcccccagcccttcatgctgaggcatctgtctggctggagaaacactaaggttggcattgtgctcacactgggaaatgacctggaggaagttgggaagaggagtccaggccggttccaacctctgggtcagaaacccggctggaaagcactggaaatagggaaatagaagaccgaaaggctggacccccctcacacccaacctgcgtgcatggccgaggttgagtgaggagtcctggagactctggcttcatgttctttgctcttgttcttctgtgcctcaggggtcgctgcccacatagttcagcgtctgacgtcagacgctgaactatgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324807 - DNA, 4050 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaactccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324808 - DNA, 3834 bp, Homo sapiens
tcgagctcggtaccgtcacgcccacagggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324809 - DNA, 3335 bp, Homo sapiens
ctctttgagagaatctggtgtgggaaacgtcttcatcaagaacctggacacatctatagatatcaaggcactttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324810 - DNA, 916 bp, Homo sapiens
agcagaaaacttagctagtacaggccctgtattcgcacgaggctctgtcgtagatatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324811 - DNA, 1306 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324812 - DNA, 1109 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatggaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324813 - DNA, 847 bp, Homo sapiens
gaatctgtgaccagcttgggaagctcctgcagggaggaaggaatgatccacaagtcccccagcccttcatgctgaggcatctgtctggctggagaaacactaaggttggcattgtgctcacactgggaaatgacctggaggaagttgggaagaggagtccaggccggttccaacctctgggtcagaaacccggctggaaagcactggaaatagggaaatagaagaccgaaaggctggacccccctcacacccaacctgcgtgcatggccgaggttgagtgaggagtcctggagactctggcttcatgttctttgctcttgttcttctgtgcctcaggggtcgctgcccacatagttcagcgtctgacgtcagacgctgaactatgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggtaagggacctcccaccaggaaaagatgggaggcagctctgactggactgtccctctggaaaacaggcccacaacaggtctcttcttagaaactcccttgtttcccatcttctggggtgaacgacagagctgtaggtctctctctgctcacctggctggctgtcaagtggccccgtgtgtcacaggatgtgcaactcattcacaccatggcagccccagggtcct

SEQ ID NO: 324814 - DNA, 1911 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgtttt

SEQ ID NO: 324815 - DNA, 4103 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324816 - DNA, 2545 bp, Homo sapiens
  misc_feature (18)..(18): n is a, c, g, or t
  misc_feature (26)..(26): n is a, c, g, or t
tacaggctggtacccccncgcagtantggatatcgatcgacccaggcgctcgggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324817 - DNA, 1171 bp, Homo sapiens
agtgtgtgagggactacaaggacagggtcaatgtcttgttcatgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324818 - DNA, 1079 bp, Homo sapiens
  misc_feature (5)..(6): n is a, c, g, or t
gccgnnctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaagaaaaaat

SEQ ID NO: 324819 - DNA, 2550 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324820 - DNA, 564 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacaggtaccagcctggggaagggcagcggggcgggcagccagaggccgcggggggtgctgaatgttgcctggctgagacctctctgtcccctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggt

SEQ ID NO: 324821 - DNA, 2493 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324822 - DNA, 2708 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaaggtaagtggcgctccagaccctccccacttcccgccctggtgacatctcatgccctaccccccaccttgcagacatttgaggggcacgatgcttctgtgctgaaggtggcctttgtgagccgtggcacgcagctgctgtccaggtgagtgggctggggtggggcagcgatggagtggggggtggcggggggacctgcctgacgctgagcctctccccaccccaaacccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324823 - DNA, 2344 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324824 - DNA, 2303 bp, Homo sapiens
  misc_feature (91)..(91): n is a, c, g, or t
ggggagcggagtacgacgtgaccctcagagcagccctgcatgcagacccagcggtgcggcgtgcagggctagttagcactctatacttgcntgggcatcgaaggccgggcacgtgtgccagcgatggcggaggccgctagtccagccatcgtgcggcaggccgatgagcacgggacgcgccgatgacccacgaaggcgttcgaccccagctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324825 - DNA, 1870 bp, Homo sapiens
cggtccccatgcacagttcggtccccatgcacagttcggtccccatgcacagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324826 - DNA, 747 bp, Homo sapiens
agatcgagctcggtaccggcatgtgctgtaggccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324827 - DNA, 516 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccaccccctgggaaacccataaaggcgcactgccctagccggtccggcctctctccagtccatc

SEQ ID NO: 324828 - DNA, 511 bp, Homo sapiens
tgctggtgacagccagtcgggcattgctgctggctcagtgggcctggcaagagggcagcgttacccgcctgtggaaggcgatacacacggcccccgtggccaccatggccttcgaccccacctccactctgctagccacaggtagggccctgccgtgcaggtgggtcgtgggcacagatgcaggggctttgggcattccaccccctcaccttgcttccccgcaggtggctgtgatggggccgtgcgcgtctgggacatcgtgcggcactacgggacacaccacttccgaggctcgcccggtgtcgtgcagtgagttggaaggtggagggggagggcagaggcaccacccaggctgcacagctcacccatcctgtcccgtccgcccacagcctagtggccttccacccggaccctacacgcctgctgctcttctcctcggccacggatgccgccatccgcgtgtggtcactgcaggaccggtcatgcctggctgtgctgactgcccactaca

SEQ ID NO: 324829 - DNA, 848 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgctggtgggtgatgcataaggcgttaacttatggtttaaggcgaggcaaacaggtcaagtcggggacagattggtcactgggcttaagtggggcaagaacggctggttggaacggaagtggtgtttaaggaatgtcaggtgggcccggggttgggagggaggttgttgggggttggggtaaaaacgtgaggg

SEQ ID NO: 324830 - DNA, 2775 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggccggctctgtctctctggactgcagtccagcccccacctgcaaacctactagcagcagaaggcatgtactgatgtttagccctgcagccaatcgacctactggaaaatcaccgggtcgaccttaagggggttgcaacaggttcaaacgaaaaaaaaaaggggctaaaccaggctatccctttaagct

SEQ ID NO: 324831 - DNA, 2636 bp, Homo sapiens
tgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacaggtaccagcctggggaagggcagcggggcgggcagccagaggccgcggggggtgctgaatgttgcctggctgagacctctctgtcccctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324832 - DNA, 1697 bp, Homo sapiens
  misc_feature (243)..(243): n is a, c, g, or t
gctctcttacgaggtgtattggtgcagttggacatctggtagcccctcctggtgagaagggtgctggcatcccgagccaacggcgccagcattggcctcaatgccaccaacgaacacagtgatgaggacgaggatgatcacatgctgcatggcaggatgcaggaggcatgtaccgacgtggaccgtagcgattgaagggaatggattgtatggaatgtttgcaggccatctatgcgatccganggagctaccctaggtgtgctccgtggggctctacccagagtatgcacgcgcatggcacttgagagagttgatctgtagagactgactagaacgatcgaggcatgacagaatccgtccacatggcactcggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatc

SEQ ID NO: 324833 - DNA, 454 bp, Homo sapiens
cagaaagcctggtacagccttgcttctaccgttttctcggttgttttggaatcgcctttgcaaaagccatgcacggctatagttctgtgatagcacccagggctcatggtctctctctgctgtgtaccaaatgcgtcgaactagcgctgaggacttcttgcaggggatgtctgtttaacagcggtcatttctgcttccctggcggtgaaagcaggaaacacctggaatccttagattctgaaaacttcatgttactctctggaatatgtgcgtgcatgtgtgtgtgtgcatgcgtgtgcatgcgtgcgtgcatgtgtataagtatgatctgctctagtgcattctctcaagtgatttttttaaactgtatgatttattgcctactttgtaaatgcaacaggcttacacagcagttggtccataacctgcccccaagcacacagccctcatgacc

SEQ ID NO: 324834 - DNA, 707 bp, Homo sapiens
tttttttccaacatattttattgtagtaaaatatacatagcataacatttaccatcttagccatatgtaggtgtgtggttcaggggcactaaatacattcacgatgttgtacggccatcacccccacacatctccagaactcttttcatcttgtacaactaaaactctgagcttcaagttggggtaagcggggcagtggggggactaaaactgtccccataaacaccaactctccattccctttttccccaaccctggcagccactattccactttctgtctctatgattttgactacgctgctttcttcacagaagtggaatcacagaatatttgtctttctgtgactggcttatttcacctagcacagtattctcaaggttcatgttgtagaaagtgtctcagtgtcctttaaggcggagtaaaatttcactgtgcataccacattttgctcattcattcatctgtcaatggacacttgggttgcttccaccttttagctattatgaataatgctgctgtgaacacgggtgttcaattacctccttgaggccctcctttcaattttttggggtatatatccagaagtaggattgctagattttaagtggaattttcattttctttagttccttttcagactgttcattgtttgttagtatttagaaatgcagctgatttttgtctattgactttttttttttttt

SEQ ID NO: 324835 - DNA, 377 bp, Homo sapiens
cccacgacttaatggcttcactgctgaattctaccaaacatttaaagaagactaataccaatcctcttcaaactattaagggaatttaagaggagggactacttccaaattttttttacaagaccaacattattctgactccaaaaccagataaggatacagcaacaacaacaaaaattataggccaatatctctgataaacacaaatccaaaaattctcaacaagatactagcaaaccaaattcaaaagcacattaaaaatgtcattcaataagatcaagggggatttatccagggaatgcaaggatagtgcaatatatgcaaatcaataaatgagataaatcgcattaacaggaaaacaaaaaccatatgatctt

SEQ ID NO: 324836 - DNA, 1044 bp, Homo sapiens
  misc_feature (927)..(927): n is a, c, g, or t
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaccgcattccaggagngagagcccccgaatggccggcggcctggtagaaagcaggcggaggccctggagggaaacaggggccaggccgcaaggaggggaaagggaggaaggacgcgcaaccaggaaacgaggg

SEQ ID NO: 324837 - DNA, 907 bp, Homo sapiens
  misc_feature (10)..(11): n is a, c, g, or t
  misc_feature (18)..(18): n is a, c, g, or t
atcgctaggnncgaggcnggggttgaatcggccgcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacattttctcgtctgtggatgtggggccatggacattaatggtgaaaagggttccgaaaagtggttttaaaacaattttagagaagagggccgaatgggaaggg

SEQ ID NO: 324838 - DNA, 997 bp, Homo sapiens
ggggaagggaagaaaaaactataggctaggtacgaggctgggtgttcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaacggagttctggatgaattgcccaaaaagtgcgatactatagtgcggtcattttcaacctaaaaggactttggtacgattccgaaaggagggcccaataaacgcgaaacgatcgagacaagggc

SEQ ID NO: 324839 - DNA, 686 bp, Homo sapiens
gactgggcaaaacagcggctcacgcctgtaatcccagcaatttgggaggccgaggcggtcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324840 - DNA, 1033 bp, Homo sapiens
tatggacagcccacttggatgtcagctatacccaggctcagaccactgcaacctaagggcagaccgcctatgcaacttcttatggacagcctcccactggttatactactccaactgccccccaggcatacaagccagcctgttccaggggtatggcactggtgcttatgataccaccactgctacagtcaccaccacccaggcctcctatgcagctcagtctgcatatggcactcagcctgcttattcagcccaccaccagcagcaacagcagcagccgccaccaccgccaatacctgcaaatgggcaacaggccagcagccaaagtgtgtatatgctaggtgatggagtagaaatggattccctctgggaatggtttcttggtttttagattagtttctcgggcttataagggaataggcctttatggcacacctttgttcttttttctctttacctcttaatacttacgatggaaaaggctgattctccggaaccaaggagcaacatgtatgacagcagttgagtacaggttgctctgctgtgttgacacattctactgttaaacagatgtctgcatgttttacctcagcttggttcttagaggtagtcatcagatgactggtagttaaaaataatatagaaaagtctttaaggcttaaatggagaagtctggtactgaatactgtacttttagccttgagcctgtaccagctcattgtaaaaagtctttaagtatatgttcctgtttgagtaccagttgtgtgcctctaagactagaaccaatcccaactttgtttatttccagagattactataaagagttgctctttcctaactcatttcattctgttgcccccagcctgaaagaatgggaactgttaaggttatgaaaattggtgagagattaggaaaatggaacagttactttgttttttgtttttttattggttggtttattctcatctgaaggtacgttttgaatgttaaaatctgatgccttgtgacatagggctgcttccttgaattgctt

SEQ ID NO: 324841 - DNA, 574 bp, Homo sapiens
gaatcataactaaagtacacgacgtgctaggtgcgaggccgggtgtttgacgcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcattaatgaactcggcagctggtgcgggtgcgggtcagctattgtctcaattttatttccgagcaatatctctaaaaaccaaaaagaaaatacagataataaacatcaaaacactataatacacatccaaaaaaacatatatataaatataaacataaaagtaaaatatactacaaaaacaatagcaaaacaaacaaacatcatactataataacaaaaaaaataaactataaacaaaaaagataaaataaaaaagtaaagaaacaaaaaagaa

SEQ ID NO: 324842 - DNA, 638 bp, Homo sapiens
tgagacagagttttgctcttgtcgcccaggctggagtgcagtggtgcaatcttggctccctgcaacctccgcctcccaggttcaagcgattctcctgcctcagcctcctgagtagctgggattacaggcatgcgccaccacttttggggttatccactagagttctaaacagacttagtcacccactcctacctaccatcaggagccttgaatagttgaatggaaatagcctccagtggagggactacagatgggtgggaagcttccaacaatggctctgttacagtgttgctctctttttctctttaagaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggta

SEQ ID NO: 324843 - DNA, 557 bp, Homo sapiens
gagttccttcggatattggaacaaggagcaacatgtatgacagcagttgagtacaggttgctctgctgtgttgacacattctactgttaaacagatgtctgcatgttttacctcagcttggttcttagaggtagtcatcagatgactggtagttaaaaataatatagaaaagtctttaaggcttaaatggagaagtctggtactgaatactgtacttttagccttgagcctgtaccagctcattgtaaaaagtctttaagtatatgttcctgtttgagtaccagttgtgtgcctctaagactagaaccaatcccaactttgtttatttccagagattactataaagagttgctctttcctaactcatttcattctgttgcccccagcctgaaagaatgggaactgttaaggttatgaaaattggtgagagattaggaaaatggaacagttactttgttttttgtttttttattggttggtttattctcatctgaaggtacgttttgaatgttaaaatctgatgccttgtgacatagggctgcttccttgaattgctt

SEQ ID NO: 324844 - DNA, 2674 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324845 - DNA, 3085 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaaaaaaaaaaaaagagatactaataagtgttctgctagatagactatttgaaaactataaatgtatttttggattaacaatgccaaggtattttttcatattcacattgaaaaatacaggcaaaactatcaatattttttctgcattatatgaaatttcacaggtagaactaaatctatgatatagaaaataatagcacattacacatagagaaaaccaagccacttaggtttagatagatatataacatgtaacatcttctctgttaaccaattatagatacatatacaacatgtaatgttttcttagttaaacaattggaaatgtttaggcattttactgtgtgggggcggtgagtatgcacatgatcagacttgtattctagctttacaattaaaattcacagaatcatt

SEQ ID NO: 324846 - DNA, 2619 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324847 - DNA, 3578 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactgccatgctacctcgtgtatttataaatgtgttggcaaatatttcctggctgcttctcaggttctttctttggattggagatgttttagctgcccatggtcctagaagttacctgctaaaaagaaagcagctgaatgctggtctcatgaggtttctttgggggttgcctcagggctgggcacacttaacagtgagtttcctggtgaactgatagttttcagtaggccagtctccttggttgagtctcctgttaatctgctcaagttctgaaatgcctctgtcttaaatacattggtgactctctgtaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttagtgtgtggtccttgatggattgtggtagaatgcactgctgtcttggactgtcttgagtattttttgtttttcagagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324848 - DNA, 2379 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagaaacgcaactacctgagaagaaccgcaactacctgagaagaaacgcaactacctg

SEQ ID NO: 324849 - DNA, 2617 bp, Homo sapiens
ggggaagggaagaaaaaactataggctaggtacgaggctgggtgtcgggagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324850 - DNA, 1775 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggta

SEQ ID NO: 324851 - DNA, 2634 bp, Homo sapiens
ggggcctgtcgctggtaacttacacgtgcccgcgtgggtcattaccaattcggcaagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324852 - DNA, 2815 bp, Homo sapiens
  misc_feature (7)..(7): n is a, c, g, or t
  misc_feature (21)..(21): n is a, c, g, or t
  misc_feature (26)..(26): n is a, c, g, or t
  misc_feature (28)..(28): n is a, c, g, or t
  misc_feature (65)..(65): n is a, c, g, or t
  misc_feature (70)..(70): n is a, c, g, or t
aacgaangatgtatgaggcgntcccngngtgtaatttcagtcacggggacgaggccgtgtatctngtcgncgttgctccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccaccaccacgacgaattccgtctgagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324853 - DNA, 2788 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324854 - DNA, 2461 bp, Homo sapiens
tctgtcttgagtatcccccgattctcagcaatagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324855 - DNA, 2542 bp, Homo sapiens
tcggcaggtagcgagcggttatcgccgaggggagaggccggtcgtccttactccaaatagtctaaatcgtaagcggacactctcctcgaatagtgcaaatcattactacgaacacaatcgaaaatcatcaatcaaccagcagcagcaccaagcagccagccgccgccacaccgcctctgcagggccgcatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324856 - DNA, 2620 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagtcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324857 - DNA, 1512 bp, Homo sapiens
  misc_feature (1499)..(1499): n is a, c, g, or t
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgacgctttggtcaggctgctattgctgtgaatggggngtactctagagtg

SEQ ID NO: 324858 - DNA, 2240 bp, Homo sapiens
tgatgttatgtgcaggttccggtcggtcgtcacactaataattcattcataaggataaaggatttggctttatccgcatggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324859 - DNA, 1800 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttttgagaaactagacactgcaacttattagtatcggcgacgtttgtttggggcaaattcagctccaggagctgaacggttgaatgcaggaggagttccagcaattgc

SEQ ID NO: 324860 - DNA, 2018 bp, Homo sapiens
ggggaagggaagaaaaaactataggctaggtacgaggctgggtgttcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324861 - DNA, 1245 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcagccgggaggaagagccgacggcccgtgaagatagtagtaggcgcagcgggat

SEQ ID NO: 324862 - DNA, 1359 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324863 - DNA, 1287 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggtttgtggggccagaaaattggggtaggaaagcggacacccagtggcaaggaagctctgggcgcgggaacgggccgcgaacaaatcgggccacaaataaatggccacggtaggtagacacactgtgcaaaacaccggcaccagagagtgtaacaagacaccgctccggcaccaccaata
